United States Patent 7,745,391 (HUMAN THROMBOSPONDIN POLYPEPTIDE) - sequence listing, part 192

SEQ ID NO: 458189 - DNA, 2582 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtaagtgtctcttttctagttactcatttatttcttcaggaagaatttgtcatgattcactttttacttcacaatgacaatttttgtcagggaagtgaaagtagagaggtacccagtttctgtcattcagttgtttaaaatatggctaaggaaaagacaattccaatatatcccagcagaagatcaaagtaaaataaaataatatcaaccataagctttatgttatggagcgtaagttcttaagttttagagaaggaaaaatattttgaaataatttttatttcttaatttattaaatgaataaaatctgggtggtctgctaggtcatggatttcctcctggtgacagaggggtaaatgaggcctacatgacgtaatcctatctaggactcacattttcgtgggagatatggatactgaaaatgtgggttaacaaacaaatatgtgcttacagattgtgataggatccataaagacatgtgagagggaacaaaaaagaagtcattctttcaataaaaaagtgcagaaggaaaggtttgctacttcttgcccaacttgggacattccttattcccactacttcctatgttatttttctccatagctcgtacatctacccactcagcaaatattaatagtttatttatgtgtctggttttttacttgtatttactcactaacatgcaaacttcgtgatggcagggatttgctcagcaattcaacaaacctggcacgtagcagatattcaattaataattattgaataaatacatgcataaatacacagataaatgcaccctcttgtttaaagagaaaatgggattggtattaacacagaatagtataattattaataaagtaaaaattgtagagaacagtaaaactcctgcgggaaaagaaagatacacctctggcgtttatagaagaaagccatccagaaccagcacagtcactcattcctgtaatcccagcactctgggagtccgaaggagggtggagtggcttgaacccaggaatttgaggccaacctgggcaacatggcaaaacccatctctacaaaaaatacaaaaattagccgggcatattgactggaacctgtaatccgagctacctgagagctgagatgggagaatcgcttgagctcaggaagcggaggttgcaatgagctgagatttcaccactaccctctagcctggatgacagagtaagaccctgtcttaaaaaaaga

SEQ ID NO: 458190 - DNA, 1007 bp, Homo sapiens
ggagggatggatcccggtcccacctaaagaagcagtctggccatgatctgccacagcggctgtgctgcactgtgaagactgctgcccagtccaatctgcccagcctccctagcactgtcagaaactaaattccagtaattggatgccaatttgctgatgacaaggcacttcctgataatgagtctggaattctgagcagcagtttcacaatctgtaattacacgtttccgccctttgcaataaggaaatacatagtttactttcatttttgactctgaggctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagaggtgctatgctatctatatgaaatagaaaaaaaagaagagatatcattgctttccttcagtgcaccatttcttacagcactaaatgattgggggtggggatgacagtaaccattttcaataatgcttttactaagggaaagattatgtgacttcacaatgataccaatcctttctcaatccatgatgcagatcattttatcatgagttgaaagaaaattggtatttctattgctcctgtatttattcttgtaattatttggattttatggcaattgtagcattagccatggaataaacatatttggaggataaaaa

SEQ ID NO: 458191 - DNA, 6869 bp, Homo sapiens
cgcgcacagctgggacgtgggccgcggccgggcgggcgcagtcgggagccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaagtctttatt

SEQ ID NO: 458192 - DNA, 420 bp, Homo sapiens
  misc_feature (381)..(381): n is a, c, g, or t
gagagagagagagagagagagagagagagagagagagagagagagagagagagagagagagagccgacagctgaaatggagtgctcaggaggaagagacaaggagaaaggaaatcacagtgagggggcaagtcccagtgaggagggggcaagagggggcaggttcctgtcaggaagggactaggtctcagtcaggaggggcaggtttcggtcaggagggggcacgtccttgtcaggagagggcgggtcccaatctggagggtgcaagtgcctgtcaggtggggacaggttccagacaacagggggcaggttcctgtcaggaaaggactaggtctcagtcaggagggggcccgtccctgtcaggtgggggcaggggtcgacncggccgcgaatttagtagtagtagtcgaccaggggccgc

SEQ ID NO: 458193 - DNA, 6176 bp, Homo sapiens
acctctgctgggacggcgtcctcaggagcctggagcgccatgcagctgctgacacagtaatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccaggaacagcagccctatttagtatactagtctgagcatgtgggtgtagctccctcagatacacatgaagagtctcccgccatccggtgcacagggagtcactgcagcatgggggaaccagccctgagaagcccagaagcctaggctgacacactgcagcctgcagtccacacctgcctactgcctgtttttcctaagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaagtctttatt

SEQ ID NO: 458194 - DNA, 3099 bp, Homo sapiens
gagagagagagagagagagagagagagagagagagagagagagagagagagagagagagagagccgacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaagtctttatt

SEQ ID NO: 458195 - DNA, 6736 bp, Homo sapiens
cgcgcacagctgggacgtgggccgcggccgggcgggcgcagtcgggagccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaagtctttatt

SEQ ID NO: 458196 - DNA, 6304 bp, Homo sapiens
cgcgcacagctgggacgtgggccgcggccgggcgggcgcagtcgggagccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgagacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaagtctttatt

SEQ ID NO: 458197 - DNA, 5904 bp, Homo sapiens
  misc_feature (5865)..(5865): n is a, c, g, or t
cgcgcacagctgggacgtgggccgcggccgggcgggcgcagtcgggagccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacaggtcgacncggccgcgaatttagtagtagtagtcgaccaggggccgc

SEQ ID NO: 458198 - DNA, 1858 bp, Homo sapiens
  misc_feature (22)..(23): n is a, c, g, or t
gcggccgcccctggggggtggnnattaacgcactcacacaacctgaagttagacagttcccgacacttgagctcctcctcccttgggaagagccatccggaagcggctcttgttcaggacgtggacgcaaccagggccggctgggagcggcgttgtcaacacacacccttggcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccatgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaagtctttatt

SEQ ID NO: 458199 - DNA, 3575 bp, Homo sapiens
cgcgcacagctgggacgtgggccgcggccgggcgggcgcagtcgggagccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaagtctttatt

SEQ ID NO: 458200 - DNA, 708 bp, Homo sapiens
tacccaaactgaaggtagctttttattactcctgtggggagcatgtacgagctctgtgtatacaccggcttcacacccacctgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaagtctttatt

SEQ ID NO: 458201 - DNA, 5391 bp, Homo sapiens
cgcgcacagctgggacgtgggccgcggccgggcgggcgcagtcgggagccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaggggtcctcataggaacggctatgagccagat

SEQ ID NO: 458202 - DNA, 3877 bp, Homo sapiens
cgcgcacagctgggacgtgggccgcggccgggcgggcgcagtcgggagccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacagagttgtggtatgagacctgggtgtctccgccacgaaa

SEQ ID NO: 458203 - DNA, 224 bp, Homo sapiens
aggaagggactaggtctcagtcaggaggggcaggtttcggtcaggagggggcacgtccttgtcaggagagggcgggtcccaatctggagggtgcaagtgcctgtcaggtggggacaggttccagacaacagggggcaggttcctgtcaggaaaggactaggtctcagtcaggagggggcccgtccctgtcaggtgggggcaggttcttgtcaggagggggaagg

SEQ ID NO: 458204 - DNA, 493 bp, Homo sapiens
ggtagatttcagttttctctttattttttaggttgtatggctcgacactcaacatcgacctgtttccggcgctcgtggtggaggacctggtgcctggcagccggctgggccccaccctgatgtgtcttctcagcacacagttcaagcgcctgcgagatggggacagaggtgagcacgtgcaccagaaaggggagcacgctcctaagccaccttcttagggactccagaggagaagagctgtcctggttgagactgagggaggcacgaggccctagtgtcttctgtgtgtccccggttgagaatgaggaaggcactgaggccctggtatcttctgtgcaccgccttgggcttacatgtccttgcagcctcaaaactcaaccacaccaggttcaatgatgcttttcccaccccttcatttataggaatatttctgttcctgtaaacctgttggacagtccatacagctaaaccactgtgggactttagaggagtt

SEQ ID NO: 458205 - DNA, 6912 bp, Homo sapiens
cgcgcacagctgggacgtgggccgcggccgggcgggcgcagtcgggagccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctaaattgccgcagctaccccagccttcagcagccaccaccctgatccgtcagcagccagcaacataaaagcaaggttctctaccagccaaaagaagaaaactctctgaaggctcagagatcttcgctttaacagaatcagagagatccaacctggggcattcaggcggctgaggaacttgaacacattgcttctcaataataatcagatcaagaggatacctagtggagcatttgaagacttggaaaatttaaaatatctatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaagtctttatt

SEQ ID NO: 458206 - DNA, 3777 bp, Homo sapiens
cgcgcacagctgggacgtgggccgcggccgggcgggcgcagtcgggagccggccgtggtggctccgtgcgtccgagcgtccgtccgcgccgtcggccatggccaagcgtcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaagtctttatt

SEQ ID NO: 458207 - DNA, 6458 bp, Homo sapiens
cgcgcacagctgggacgtgggccgcggccgggcgggcgcagtcgggagccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaagtctttatt

SEQ ID NO: 458208 - DNA, 6630 bp, Homo sapiens
cgcgcacagctgggacgtgggccgcggccgggcgggcgcagtcgggagccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaagtctttatt

SEQ ID NO: 458209 - DNA, 1923 bp, Homo sapiens
  misc_feature (22)..(23): n is a, c, g, or t
gcggccgcccctggggggtggnnattaacgcactcacacaacctgaagttagacagttcccgacacttgagctcctcctcccttgggaagagccatccggaagcggctcttgttcaggacgtggacgcaaccagggccggctgggagcggcgttgtcaacacacacccttggcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccaaatgtgaaaaaacctccttcatcccattgtgtatctgatacctgccgagggccaagggtgtgtgttgacaacgccgctcccagccggccctggttgcgtccacgtcctgaacaagagccgcttccggatggctcttcccaagggaggaggagctcaagtgtcgggaactgtctaacttcaggttgtgtgagtgcgttaaaaaaaaaaaaaaaaaaaagaatccctatacctcatttgtatttttaaaatgcgtgatgttttatgaaattgtgtccattttttaggtattagatatggcagaaaaaccatttccactatgcaaagttcttttagacgtcagtgaaaatcaactctcatacctcatggtctctctttaattgaccaaaaccttccatttttctctaaatacaaagcgatctgtgttctgagcaacctttccccgaacacacagcttcagtgcagcacgctgacctgagtatccaccatgtgccaggcacagtgctgggcacacgaggcaccaaggtccgggccacctgcccgcagcaaggcccagctgaggtggtggagggagcccctgaggtcaggggccgtttcggttcagggtggcaggtgtccagcactggggtatggcgtcgaggcttccatggggtgggggaggccagcttccttctgacaggatgggcgcatacagtgcctggtgtgatttgtgcacaacccgtgttccaggtgcacatcctcccaaggagacacccagacccttccagcacgggccggccaagttgctgcggcggaggcagcatttcagctgtgaggaaggtcattggattcatgtgttttatctgtaaaaatggttgtcttaacttcttaacctcatattggtaagtgattgataaaaattggttggtgtttcatgacatgtggacttcttttgaaatagcaagtcaaatgtagtgaccaaattgtggaagagatttctgtcaaataggaaatgtgtaagttcgtctaaaagctgatggttatgtaagttgctcaggcactcagatgacagcagattctgggttctgggagtgttctgtgcctcttacatgccctggaggcctcatggtctcagtgctgaggcggcacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaagtctttatt

SEQ ID NO: 458210 - DNA, 5385 bp, Homo sapiens
cgcgcacagctgggacgtgggccgcggccgggcgggcgcagtcgggagccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtctgctgtgccatcgtgagatcgggtggccgatggcagggagctgcggactgcagaccaggaaacacccagaactcgtgacatttcatgacaacgtccagctggtgctgttacagaaggcagtgcaggaggcttccaaccagagcatctgcggagaaggaggcacagcaggtgcctgaagggaagcaggcaggagtcctagcttcacgttagacttctcaggtttttatttaattcttttaaaatgaaaaattggtgctactattaaattgcacagttgaatcatttaggcgcctaaattgattttgcctcccaacaccatttctttttaaataaagcaggatacctctatatgtcagccttgccttgttcagatgccaggagccggcagacctgtcacccgcaggtggggtgagtctcggagctgccagaggggctcaccgaaatcggggttccatcacaagctatgtttaaaaagaaaattggtgtttggcaaacggaacagaacctttgatgagagcgttcacagggacactgtctgggggtgcagtgcaagcccccggcctcttccctgggaacctctgaactcctccttcctctgggctctctgtaacatttcaccacacgtcagcatctaatcccaagacaaacattcccgctgctcgaagcagctgtatagcctgtgactctccgtgtgtcagctccttccacacctgattagaacattcataagccacatttagaaacagatttgctttcagctgtcacttgcacacatactgcctagttgtgaaccatcaaacatgcgggatcctctaggagt

SEQ ID NO: 458211 - DNA, 4951 bp, Homo sapiens
cgcgcacagctgggacgtgggccgcggccgggcgggcgcagtcgggagccggccgtggtggctccgtgcgtccgagcgtccgtccgcgccgtcggccatggccaagcgctccaggggccccgggcgccgctgcctgttggcgctcgtgctgttctgcgcctgggggacgctggccgtggtggcccagaagccgggcgcagggtgtccgagccgctgcctgtgcttccgcaccaccgtgcgctgcatgcatctgctgctggaggccgtgcccgccgtggcgccgcagacctccatcctagatcttcgctttaacagaatcagagagatccaacctggggcattcaggcggctgaggaacttgaacacattgcttctcaataataatcagatcaagaggatacctagtggagcatttgaagacttggaaaatttaaaatatctctatctgtacaagaatgagatccagtcaattgacaggcaagcatttaagggacttgcctctctagagcaactatacctgcactttaatcagatagaaactttggacccagattcgttccagcatctcccgaagctcgagaggctatttttgcataacaaccggattacacatttagttccagggacatttaatcacttggaatctatgaagagattgcgactggactcaaacacacttcactgcgactgtgaaatcctgtggttggcggatttgctgaaaacctacgcggagtcggggaacgcgcaggcagcggccatctgtgaatatcccagacgcatccagggacgctcagtggcaaccatcaccccggaagagctgaactgtgaaaggccccggatcacctccgagccccaggacgcagatgtgacctcggggaacaccgtgtacttcacctgcagagccgaaggcaaccccaagcctgagatcatctggctgcgaaacaataatgagctgagcatgaagacagattcccgcctaaacttgctggacgatgggaccctgatgatccagaacacacaggagacagaccagggtatctaccagtgcatggcaaagaacgtggccggagaggtgaagacgcaagaggtgaccctcaggtacttcgggtctccagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaacgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatcgacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtggacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctaggctcctgggaggctcctcagagtttgtacacctgtagcacacctgcgtaatgtgcggtctgggccagtcacaaggaattgtgttgtctaagccaaagggggaagctgactgtgatttaccaaaaaaaattctgtaattcaaaccaaaatgtctgcggaatcaccagtttgatactctctgtaatcagaacagtgggcagtgcctgggtgaacgtgtctagcagccactgtgcgggatcgctgtaacaggagtggaatgtacatatttatttacttttctaactgctccaacagccaaatgccttttttatgaccattgtattcagttcattaccaaagaaatgtttgcactttgtaatgatgcctttcagttcaaataaatgggtcacattttcaaatggaaaaagtctttatt

SEQ ID NO: 458212 - DNA, 745 bp, Homo sapiens
tcacatccaggttacgctgatgcaagaggtgggttcccttggtcttcagcagctccacccctgtcactttgcagggtacagcttccctcctgactacttccatgggctggcattgaatgtctgtggcttttccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagaggtgaggccaattaaaattgcagctgatgtgaagagagttgtgactggtgcaggcaggagtgtttttccatttccacatctaagaatttgttgagtttgttgcccaaaggctgggagtttgttcaatcaagctgttaactgtcttgtgaaactgttctattcagacttttctacaaagtaattaaaaacctaggttggctgtcagagaatataattagaagtaatctttcatcattattactatggtatgaaactcgccaaaaagc

SEQ ID NO: 458213 - DNA, 6583 bp, Homo sapiens
agcggagaacagaaagctaaggcaaaggagggaggatgctgtggtcatcctttcttgtttttttcttctttaatgaggatagagcacatgtgagattttactttctactccagtaaaaattctgaagaattgcattggagactgttatattcaacacatacgtggattctgtgttatgatttacatttttctttatttcagcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtcctaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggctgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgt

SEQ ID NO: 458214 - DNA, 174 bp, Homo sapiens
tcaagattatcttcatgatattgaagctcaattaagcagtaacatgataattactttttaagtttatatgcaacttccacatactttgcgcccttctaggcggcagctgcagccgcatctgctgaatcaagagacttcagtggtgctggtgggataggagttttttcagagagt

SEQ ID NO: 458215 - DNA, 6436 bp, Homo sapiens
ttcttggtgccagcttatcaatcccaaactctgggtgtaaaagattctacagggcactttcttatgcaaggagctaaacagtgattaaaggagcaggatgaaaagatggcacagtcagtgctggtaccgccaggacctgacagcttccgcttctttaccagggaatcccttgctgctattgaacaacgcattgcagaagagaaagctaagagacccaaacaggaacgcaaggatgaggatgatgaaaatggcccaaagccaaacagtgacttggaagcaggaaaatctcttccatttatttatggagacattcctccagagatggtgtcagtgcccctggaggatctggacccctactatatcaataagaaaacgtttatagtattgaataaagggaaagcaatctctcgattcagtgccacccctgccctttacattttaactcccttcaaccctattagaaaattagctattaagattttggtacattctttattcaatatgctcattatgtgcacgattcttaccaactgtgtatttatgaccatgagtaaccctccagactggacaaagaatgtggagtatacctttacaggaatttatacttttgaatcacttattaaaatacttgcaaggggcttttgtttagaagatttcacatttttacgggatccatggaattggttggatttcacagtcattacttttgcatatgtgacagagtttgtggacctgggcaatgtctcagcgttgagaacattcagagttctccgagcattgaaaacaatttcagtcattccaggcctgaagaccattgtgggggccctgatccagtcagtgaagaagctttctgatgtcatgatcttgactgtgttctgtctaagcgtgtttgcgctaataggattgcagttgttcatgggcaacctacgaaataaatgtttgcaatggcctccagataattcttcctttgaaataaatatcacttccttctttaacaattcattggatgggaatggtactactttcaataggacagtgagcatatttaactgggatgaatatattgaggataaaagtcacttttattttttagaggggcaaaatgatgctctgctttgtggcaacagctcagatgcaggccagtgtcctgaaggatacatctgtgtgaaggctggtagaaaccccaactatggctacacgagctttgacacctttagttgggcctttttgtccttatttcgtctcatgactcaagacttctgggaaaacctttatcaactgacactacgtgctgctgggaaaacgtacatgatattttttgtgctggtcattttcttgggctcattctatctaataaatttgatcttggctgtggtggccatggcctatgaggaacagaatcaggccacattggaagaggctgaacagaaggaagctgaatttcagcagatgctcgaacagttgaaaaagcaacaagaagaagctcaggcggcagctgcagccgcatctgctgaatcaagagacttcagtggtgctggtgggataggagttttttcagagagttcttcagtagcatctaagttgagctccaaaagtgaaaaagagctgaaaaacagaagaaagaaaaagaaacagaaagaacagtctggagaagaagagaaaaatgacagagtcctaaaatcggaatctgaagacagcataagaagaaaaggtttccgtttttccttggaaggaagtaggctgacatatgaaaagagattttcttctccacaccagtccttactgagcatccgtggctcccttttctctccaagacgcaacagtagggcgagccttttcagcttcagaggtcgagcaaaggacattggctctgagaatgactttgctgatgatgagcacagcacctttgaggacaatgacagccgaagagactctctgttcgtgccgcacagacatggagaacggcgccacagcaatgtcagccaggccagccgtgcctccagggtgctccccatcctgcccatgaatgggaagatgcatagcgctgtggactgcaatggtgtggtctccctggtcgggggcccttctaccctcacatctgctgggcagctcctaccagagggcacaactactgaaacagaaataagaaagagacggtccagttcttatcatgtttccatggatttattggaagatcctacatcaaggcaaagagcaatgagtatagccagtattttgaccaacaccatggaagaacttgaagaatccagacagaaatgcccaccatgctggtataaatttgctaatatgtgtttgatttgggactgttgtaaaccatggttaaaggtgaaacaccttgtcaacctggttgtaatggacccatttgttgacctggccatcaccatctgcattgtcttaaatacactcttcatggctatggagcactatcccatgacggagcagttcagcagtgtactgtctgttggaaacctggtcttcacagggatcttcacagcagaaatgtttctcaagataattgccatggatccatattattactttcaagaaggctggaatatttttgatggttttattgtgagccttagtttaatggaacttggtttggcaaatgtggaaggattgtcagttctccgatcattccggctgctccgagttttcaagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggttctgaacctcttcttggccttgcttttgagttccttcagttctgacaatcttgctgccactgatgatgataacgaaatgaataatctccagattgctgtgggaaggatgcagaaaggaatcgattttgttaaaagaaaaatacgtgaatttattcagaaagcctttgttaggaagcagaaagctttagatgaaattaaaccgcttgaagatctaaataataaaaaagacagctgtatttccaaccataccaccatagaaataggcaaagacctcaattatctcaaagacggaaatggaactactagtggcataggcagcagtgtagaaaaatatgtcgtggatgaaagtgattacatgtcatttataaacaaccctagcctcactgtgacagtaccaattgctgttggagaatctgactttgaaaatttaaatactgaagaattcagcagcgagtcagatatggaggaaagcaaagagaagctaaatgcaactagttcatctgaaggcagcacggttgatattggagctcccgccgagggagaacagcctgaggttgaacctgaggaatcccttgaacctgaagcctgttttacagaagactgtgtacggaagttcaagtgttgtcagataagcatagaagaaggcaaagggaaactctggtggaatttgaggaaaacatgctataagatagtggagcacaattggttcgaaaccttcattgtcttcatgattctgctgagcagtggggctctggcctttgaagatatatacattgagcagcgaaaaaccattaagaccatgttagaatatgctgacaaggttttcacttacatattcattctggaaatgctgctaaagtgggttgcatatggttttcaagtgtattttaccaatgcctggtgctggctagacttcctgattgttgatgtctcactggttagcttaactgcaaatgccttgggttactcagaacttggtgccatcaaatccctcagaacactaagagctctgaggccactgagagctttgtcccggtttgaaggaatgagggctgttgtaaatgctcttttaggagccattccatctatcatgaatgtacttctggtttgtctgatcttttggctaatattcagtatcatgggagtgaatctctttgctggcaagttttaccattgtattaattacaccactggagagatgtttgatgtaagcgtggtcaacaactacagtgagtgcaaagctctcattgagagcaatcaaactgccaggtggaaaaatgtgaaagtaaactttgataacgtaggacttggatatctgtctctacttcaagtagccacgtttaagggatggatggatattatgtatgcagctgttgattcacgaaatgtagaattacaacccaagtatgaagacaacctgtacatgtatctttattttgtcatctttattatttttggttcattctttaccttgaatcttttcattggtgtcatcatagataacttcaaccaacagaaaaagaagtttggaggtcaagacatttttatgacagaagaacagaagaaatactacaatgcaatgaaaaaactgggttcaaagaaaccacaaaaacccatacctcgacctgctaacaaattccaaggaatggtctttgattttgtaaccaaacaagtctttgatatcagcatcatgatcctcatctgccttaacatggtcaccatgatggtggaaaccgatgaccagagtcaagaaatgacaaacattctgtactggattaatctggtgtttattgttctgttcactggagaatgtgtgctgaaactgatctctcttcgttactactatttcactattggatggaatatttttgattttgtggtggtcattctctccattgtaggaatgtttctggctgaactgatagaaaagtattttgtgtcccctaccctgttccgagtgatccgtcttgccaggattggccgaatcctacgtctgatcaaaggagcaaaggggatccgcacgctgctctttgctttgatgatgtcccttcctgcgttgtttaacatcggcctccttcttttcctggtcatgttcatctacgccatctttgggatgtccaattttgcctatgttaagagggaagttgggatcgatgacatgttcaactttgagacctttggcaacagcatgatctgcctgttccaaattacaacctctgctggctgggatggattgctagcacctattcttaatagtggacctccagactgtgaccctgacaaagatcaccctggaagctcagttaaaggagactgtgggaacccatctgttgggattttcttttttgtcagttacatcatcatatccttcctggttgtggtgaacatgtacatcgcggtcatcctggagaacttcagtgttgctactgaagaaagtgcagagcctctgagtgaggatgactttgagatgttctatgaggtttgggagaagtttgatcccgatgcgacccagtttatagagtttgccaaactttctgattttgcagatgccctggatcctcctcttctcatagcaaaacccaacaaagtccagctcattgccatggatctgcccatggtgagtggtgaccggatccactgtcttgacatcttatttgcttttacaaagcgtgttttgggtgagagtggagagatggatgcccttcgaatacagatggaagagcgattcatggcatcaaacccctccaaagtctcttatgagcccattacgaccacgttgaaacgcaaacaagaggaggtgtctgctattattatccagagggcttacagacgctacctcttgaagcaaaaagttaaaaaggtatcaagtatatacaagaaagacaaaggcaaagaatgtgatggaacacccatcaaagaagatactctcattgataaactgaatgagaattcaactccagagaaaaccgatatgacgccttccaccacgtctccaccctcgtatgatagtgtgaccaaaccagaaaaagaaaaatttgaaaaagacaaatcagaaaaggaagacaaagggaaagatatcagggaaagtaaaaagtaaaaagaaaccaagaattttccattttgtgatcaattgtttacagcccgtgatggtgatgtgtttgtgtcaacaggactcccacaggaggtctatgccaaactgactgtttttacaaatgtatacttaaggtcagtgcctataacaagacagagacctctggtcagcaaactggaactcagtaaactggagaaatagtatcgatgggaggtttctattttcacaaccagctgacactgctgaagagcagaggcgtaatggctactcagacgataggaaccaatttaaaggggggagggaagttaaatttttatgt

SEQ ID NO: 458216 - DNA, 399 bp, Homo sapiens
aagttggcaaaatcttggccaactctaaatatgctaattaagatcattggcaattctgtgggggctctaggaaacctcaccttggtattggccatcatcgtcttcatttttgctgtggtcggcatgcagctctttggtaagagctacaaagaatgtgtctgcaagatttccaatgattgtgaactcccacgctggcacatgcatgactttttccactccttcctgatcgtgttccgcgtgctgtgtggagagtggatagagaccatgtgggactgtatggaggtcgctggccaaaccatgtgccttactgtcttcatgatggtcatggtgattggaaatctagtggtatgtagcaaaaacattttcctcattttcattaaaagataatgtaatcattaa

SEQ ID NO: 458217 - DNA, 4076 bp, Homo sapiens
agccgggaggagcgggcgcgagcggggcagagcgcggcgcggggccggcggcgaaggtccggggtggaatcgacgtcgctgcggctgccgacgacccacacccggccggccgcctccgcagacccaccttggccgcgcggcagggggcgcgcagagccccgagggagcgagtccccgcgcgtggcagctcggcggcttctcccttcgggaggtccggctcccggctctccggacccgcctggcgtcctcgcctgcggcggggcggacgacagcggcgcccaggaatggcttcggcgggcagcggcatggaggaggtgcgcgtgtcggtgctgacccccttgaagctggtcgggctggtgtgcatcttcctggcgctgtgtctggacctgggggcggtgctgagcccggcctgggtcacagctgaccaccagtactacctgtcgttgtgggagtcctgccgcaaacccgccagcttggacatctggcactgcgagtccacgctcagcagcgattggcagattgctactctggctttactcctgggcggcgctgccatcattctcattgcattcctggtgggtttgatttctatctgcgtgggatctcgaaggcgtttctatagacctgttgcggtcatgctttttgcagcagttgttttacaggtttgcagcctggtcctttacccaatcaagttcattgaaactgtgagcttgaaaatttaccatgagttcaactggggttatggcctggcctggggtgcaactatattttcgtttgggggtgccatcctttattgcctgaaccctaagaactatgaagactactactagaaccaatagtctcaaagtaaaaacaaccaccaccatccaacaaaaggattacgtctgcatcttttctaacttactattttctaaaacacttgtggagcatcaagcagtttgctcagttgatttaatcttttttgccttttggctgtcaacatcataaccagcttttacatccattttagaaatctgcacaaattaagagagctgattagacataggcaaatgctgcaaacttccaatatgttcatatcgtttttcttgacaaatgaagggtctatatgacagcaaccattgtgagaaactagttggaatgagatttgcctcaatctcctattgcctgcaggggagcagttggcataagcaacatttagaagttcctttgcgctgacaaggattccactgttagagcccttaccgcctgcttatcctacccaatgactacattggctgttggttatttgcttgagtgagcccttgaaaaatgaactgcccttcagcatctaatgggagttgtgaatgtaactggttaatgatacacattccaccttcaggaacactctttttaatgggaggttatgctttggcaatcagcgtctccctgggaagagagtcaagacttggagacatgtgcttctcattatgtggttagaaattggtgcctcagccctatctagactggggaaaaattgaggatctctgtttttcctggggcaaacagaaagaaatctgcatgagttgcttttgtaccctttaaatcatttgccaaacattgcagcaaacaagtgtgcgtatgtaacaagcttcactgtttttatagaaggtgaaccattagtataaatggtaataagttgttccctaaccctccacatacatttgcctatcacacgtaaaattaatatttactctagtgaagtggtttgagcactaaccttgtacacattgttaagaggcttagattggtattcatacttatttaccatacaaaagtatggtaccttaaagcttttgctctatgttctttactgtttcactggaaagtgtcaatagagttgcctaagaataaaaattgaaatggtgttaatctgaaaattaatgattctctgtaagcactgtagttgaaaagagagtagcaattaggatgatcattttgtgtaaaattcattaaaatagaaggctgctattttttgcaagtattttaaatgtcttcatttttttaagaaaggaatagcgatagatttatataaatatctaaatgtctcagtagaggagtagaattcatctggttatcacctggtcctctgaagttaactgatgggctaaccgatttgtgcacacacttaggatggatttatgttaagggaattacttactgactgttcaatggaaggaagtattaataatagggaataagtttgcaactaatctcatgctgcaaacttgtgttaattctgtttaatatacaaatttggatagcttaattataaacatatttttatatcaaatatacagttctaatataaaagttataaataattatttttgttaacaaagacactaaaacagtatgttctggttttggccctcttgcagaaagaagcattagaaaaattactttaaaagtagctatatgttactgtattgcaaaatctgttaagagcaggaccacatcgatagtatttaataatttgttttacctcccaaaacacagttcttctttcagcttgtcttaagaatggttgccaaaaacaacagccaaaaaaaaaaaaacctattttattatccaaatgctagaaaacacacatgaattttctataaaatcacgaatatgaagtaccaggtttagtcttactttagcaatgatagacaaaagcgaataaatacatcacagacagaaacctttataaaaatatatgattctataaagaatcattagaaattatgagtggaaattctccagaaagatagtattatagagtcttttgaagcaattttttgagaaatagtaaaatctggggcagagtgtcttgcagttaattgcatattgtcagagcagcatgagaaatatgatatttggatagggatttcagcaactaaacattctctgttctgagatctctttattcctgaataatgaaagaatagtactttggtgctgacaccaatgaggcacttctcttggtcctagtagaggatgcagtgtactgttaaaccaatatcatcacatctcgagtcttatcaagttttcattctctgtcaatatgacaagctcaaagtgacagaatatgttataggttgaagcacacatatttgcagtttactgaaaagtagatttcttatgtgacttttttcccttctcagcaaagagccctacactagatttctaccatcactaatatttggaagtatttcattactaacaatctcagtacaacatgaaaattgttgcttctcatctaaaatacaattttgtctatcagaataaacacaagtgaaattttcacctacattaacattatgtctttgcagctttaggtttgttagatgtgttcttaagcataatttttagccacaaacccattgttagatagatatctatggatatagatctacatctatagatatagatatacacacatatatatactcacacacatatagcataaaatactcagcagggctagttattccgatttcttgcacaattatttagctttttgtaagttcaacatgtaaattttaaagacataaatatagagagacttatgtgtttgaatataaatgatatatatggattagcatgtacctgtatattattaaacatgcaatgaactgactggtaagtgacgtctaattgtatggctagcaatgtaatttattcagactgtatttttgtacagagcagtgcactctaacctatgcctctgtgtcctctttaatgcctaaagctgtgcctagaaatttcatctgtcttaaaagtaaaatatacttcatgctgtttatgctattagtttctgtactgctattctatatttattatttttaaatatatgacatgtttactacttaaacatgaattcatggtatcctggttattttttttaagtcatctgggggaaaacctgtttatcactccagtgattttgagtttgcagtttcacaatcagttcttcatttcatgatttttgtagttgacatgaagtcatctatgtggaaaaaaataaaaataaaagtgatttcacggatgtggtt

SEQ ID NO: 458218 - DNA, 4052 bp, Homo sapiens
agccgggaggagcgggcgcgagcggggcagagcgcggcgcggggccggcggcgaaggtccggggtggaatcgacgtcgctgcggctgccgacgacccacacccggccggccgcctccgcagacccaccttggccgcgcggcagggggcgcgcagagccccgagggagcgagtccccgcgcgtggcagctcggcggcttctcccttcgggaggtccggctcccggctctccggacccgcctggcgtcctcgcctgcggcggggcggacgacagcggcgcccaggaatggcttcggcgggcagcggcatggaggaggtgcgcgtgtcggtgctgacccccttgaagctggtcgggctggtgtgcatcttcctggcgctgtgtctggacctgggggcggtgctgagcccggcctgggtcacagctgaccaccagtactacctgtcgttgtgggagtcctgccgcaaacccgccagcttggacatctggcactgcgagtccacgctcagcagcgattggcagattgctactctggctttactcctgggcggcgctgccatcattctcattgcattcctggtgggtttgatttctatctgcgtgggatctcgaaggcgtttctatagacctgttgcggtcatgctttttgcagcagttgttttacaggtttgcagcctggtcctttacccaatcaagttcattgaaactgtgagcttgaaaatttaccatgagttcaactggggttatggcctggcctggggtgcaactatattttcgtttgggggtgccatcctttattgcctgaaccctaagaactatgaagactactactagaaccaatagtctcaaagtaaaaacaaccaccaccatccaacaaaaggattacgtctgcatcttttctaacttactattttctaaaacacttgtggagcatcaagcagtttgctcagttgatttaatcttttttgccttttggctgtcaacatcataaccagcttttacatccattttagaaatctgcacaaattaagagagctgattagacataggcaaatgctgcaaacttccaatatgttcatatcgtttttcttgacaaatgaagggtctatatgacagcaaccattgtgagaaactagttggaatgagatttgcctcaatctcctattgcctgcaggggagcagttggcataagcaacatttagaagttcctttgcgctgacaaggattccactgttagagcccttaccgcctgcttatcctacccaatgactacattggctgttggttatttgcttgagtgagcccttgaaaaatgaactgcccttcagcatctaatgggagttgtgaatgtaactggttaatgatacacattccaccttcaggaacactctttttaatgggaggttatgctttggcaatcagcgtctccctgggaagagagtcaagacttggagacatgtgcttctcattatgtggttagaaattggtgcctcagccctatctagactggggaaaaattgaggatctctgtttttcctggggcaaacagaaagaaatctgcatgagttgcttttgtaccctttaaatcatttgccaaacattgcagcaaacaagtgtgcgtatgtaacaagcttcactgtttttatagaaggtgaaccattagtataaatggtaataagttgttccctaaccctccacatacatttgcctatcacacgtaaaattaatatttactctagtgaagtggtttgagcactaaccttgtacacattgttaagaggcttagattggtattcatacttatttaccatacaaaagtatggtaccttaaagcttttgctctatgttctttactgtttcactggaaagtgtcaatagagttgcctaagaataaaaattgaaatggtgttaatctgaaaattaatgattctctgtaagcactgtagttgaaaagagagtagcaattaggatgatcattttgtgtaaaattcattaaaatagaaggctgctattttttgcaagtattttaaatgtcttcatttttttaagaaaggaatagcgatagatttatataaatatctaaatgtctcagtagaggagtagaattcatctggttatcacctggtcctctgaagttaactgatgggctaaccgatttgtgcacacacttaggatggatttatgttaagggaattacttactgactgttcaatggaaggaagtattaataatagggaataagtttgcaactaatctcatgctgcaaacttgtgttaattctgtttaatatacaaatttggatagcttaattataaacatatttttatatcaaatatacagttctaatataaaagttataaataattatttttgttaacaaagacactaaaacagtatgttctggttttggccctcttgcagaaagaagcattagaaaaattactttaaaagtagctatatgttactgtattgcaaaatctgttaagagcaggaccacatcgatagtatttaataatttgttttacctcccaaaacacagttcttctttcagcttgtcttaagaatggttgccaaaaacaacagccaaaaaaaaaaaaacctattttattatccaaatgctagaaaacacacatgaattttctataaaatcacgaatatgaagtaccaggtttagtcttactttagcaatgatagacaaaagcgaataaatacatcacagacagaaacctttataaaaatatatgattctataaagaatcattagaaattatgagtggaaattctccagaaagatagtattatagagtcttttgaagcaattttttgagaaatagtaaaatctggggcagagtgtcttgcagttaattgcatattgtcagagcagcatgagaaatatgatatttggatagggatttcagcaactaaacattctctgttctgagatctctttattcctgaataatgaaagaatagtactttggtgctgacaccaatgaggcacttctcttggtcctagtagaggatgcagtgtactgttaaaccaatatcatcacatctcgagtcttatcaagttttcattctctgtcaatatgacaagctcaaagtgacagaatatgttataggttgaagcacacatatttgcagtttactgaaaagtagatttcttatgtgacttttttcccttctcagcaaagagccctacactagatttctaccatcactaatatttggaagtatttcattactaacaatctcagtacaacatgaaaattgttgcttctcatctaaaatacaattttgtctatcagaataaacacaagtgaaattttcacctacattaacattatgtctttgcagctttaggtttgttagatgtgttcttaagcataatttttagccacaaacccattgttagatagatatctatggatatagatctacatctatagatatagatatacacacatatatatactcacacacatatagcataaaatactcagcagggctagttattccgatttcttgcacaattatttagctttttgtaagttcaacatgtaaattttaaagacataaatatagagagacttatgtgtttgaatataaatgatatatatggattagcatgtacctgtatattattaaacatgcaatgaactgactggtaagtgacgtctaattgtatggctagcaatgtaatttattcagactgtatttttgtacagagcagtgcactctaacctatgcctctgtgtcctctttaatgcctaaagctgtgcctagaaatttcatctgtcttaaaagtaaaatatacttcatgctgtttatgctattagtttctgtactgctattctatatttattatttttaaatatatgacatgtttactacttaaacatgaattcatggtatcctggttattttttttaagtcatctggggacactgtttcatcaggattgattgcgtcccacgtctcttcgacttggtgctgagcttggtataggtgggaatttctgagcaagacgcacccagctcacgacacaacacaccc

SEQ ID NO: 458219 - DNA, 3875 bp, Homo sapiens
agccgggaggagcgggcgcgagcggggcagagcgcggcgcggggccggcggcgaaggtccggggtggaatcgacgtcgctgcggctgccgacgacccacacccggccggccgcctccgcagacccaccttggccgcgcggcagggggcgcgcagagccccgagggagcgagtccccgcgcgtggcagctcggcggcttctcccttcgggaggtccggctcccggctctccggacccgcctggcgtcctcgcctgcggcggggcggacgacagcggcgcccaggaatggcttcggcgggcagcggcatggaggaggtgcgcgtgtcggtgctgacccccttgaagctggtcgggctggtgtgcatcttcctggcgctgtgtctggacctgggggcggtgctgagcccggcctgggtcacagctgaccaccagtactacctgtcgttgtgggagtcctgccgcaaacccgccagcttggacatctggcactgcgagtccacgctcagcagcgattggcagattgctactctggctttactcctgggcggcgctgccatcattctcattgcattcctggtgggtttgatttctatctgcgtgggatctcgaaggcgtttctatagacctgttgcggtcatgctttttgcagcagttgttttacaggtttgcagcctggtcctttacccaatcaagttcattgaaactgtgagcttgaaaatttaccatgagttcaactggggttatggcctggcctggggtgcaactatattttcgtttgggggtgccatcctttattgcctgaaccctaagaactatgaagactactactagaaccaatagtctcaaagtaaaaacaaccaccaccatccaacaaaaggattacgtctgcatcttttctaacttactattttctaaaacacttgtggagcatcaagcagtttgctcagttgatttaatcttttttgccttttggctgtcaacatcataaccagcttttacatccattttagaaatctgcacaaattaagagagctgattagacataggcaaatgctgcaaacttccaatatgttcatatcgtttttcttgacaaatgaagggtctatatgacagcaaccattgtgagaaactagttggaatgagatttgcctcaatctcctattgcctgcaggggagcagttggcataagcaacatttagaagttcctttgcgctgacaaggattccactgttagagcccttaccgcctgcttatcctacccaatgactacattggctgttggttatttgcttgagtgagcccttgaaaaatgaactgcccttcagcatctaatgggagttgtgaatgtaactggttaatgatacacattccaccttcaggaacactctttttaatgggaggttatgctttggcaatcagcgtctccctgggaagagagtcaagacttggagacatgtgcttctcattatgtggttagaaattggtgcctcagccctatctagactggggaaaaattgaggatctctgtttttcctggggcaaacagaaagaaatctgcatgagttgcttttgtaccctttaaatcatttgccaaacattgcagcaaacaagtgtgcgtatgtaacaagcttcactgtttttatagaaggtgaaccattagtataaatggtaataagttgttccctaaccctccacatacatttgcctatcacacgtaaaattaatatttactctagtgaagtggtttgagcactaaccttgtacacattgttaagaggcttagattggtattcatacttatttaccatacaaaagtatggtaccttaaagcttttgctctatgttctttactgtttcactggaaagtgtcaatagagttgcctaagaataaaaattgaaatggtgttaatctgaaaattaatgattctctgtaagcactgtagttgaaaagagagtagcaattaggatgatcattttgtgtaaaattcattaaaatagaaggctgctattttttgcaagtattttaaatgtcttcatttttttaagaaaggaatagcgatagatttatataaatatctaaatgtctcagtagaggagtagaattcatctggttatcacctggtcctctgaagttaactgatgggctaaccgatttgtgcacacacttaggatggatttatgttaagggaattacttactgactgttcaatggaaggaagtattaataatagggaataagtttgcaactaatctcatgctgcaaacttgtgttaattctgtttaatatacaaatttggatagcttaattataaacatatttttatatcaaatatacagttctaatataaaagttataaataattatttttgttaacaaagacactaaaacagtatgttctggttttggccctcttgcagaaagaagcattagaaaaattactttaaaagtagctatatgttactgtattgcaaaatctgttaagagcaggaccacatcgatagtatttaataatttgttttacctcccaaaacacagttcttctttcagcttgtcttaagaatggttgccaaaaacaacagccaaaaaaaaaaaaacctattttattatccaaatgctagaaaacacacatgaattttctataaaatcacgaatatgaagtaccaggtttagtcttactttagcaatgatagacaaaagcgaataaatacatcacagacagaaacctttataaaaatatatgattctataaagaatcattagaaattatgagtggaaattctccagaaagatagtattatagagtcttttgaagcaattttttgagaaatagtaaaatctggggcagagtgtcttgcagttaattgcatattgtcagagcagcatgagaaatatgatatttggatagggatttcagcaactaaacattctctgttctgagatctctttattcctgaataatgaaagaatagtactttggtgctgacaccaatgaggcacttctcttggtcctagtagaggatgcagtgtactgttaaaccaatatcatcacatctcgagtcttatcaagttttcattctctgtcaatatgacaagctcaaagtgacagaatatgttataggttgaagcacacatatttgcagtttactgaaaagtagatttcttatgtgacttttttcccttctcagcaaagagccctacactagatttctaccatcactaatatttggaagtatttcattactaacaatctcagtacaacatgaaaattgttgcttctcatctaaaatacaattttgtctatcagaataaacacaagtgaaattttcacctacattaacattatgtctttgcagctttaggtttgttagatgtgttcttaagcataatttttagccacaaacccattgttagatagatatctatggatatagatctacatctatagatatagatatacacacatatatatactcacacacatatagcataaaatactcagcagggctagttattccgatttcttgcacaattatttagctttttgtaagttcaacatgtaaattttaaagacataaatatagagagacttatgtgtttgaatataaatgatatatatggattagcatgtacctgtatattattaaacatgcaatgaactgactggtaagtgacgtctaattgtatggctagcaatgtaatttattcagactgtatttttgtacagagcagtgcactctaacctatgcctctgtgtcctctttaatgcctaaagctgtgcctagaaatttcatctgtcttgttatatttttaaatatatgacatgttactacttaacctgattcctgtgacccgggaattttttggtcctgggggcc

SEQ ID NO: 458220 - DNA, 3761 bp, Homo sapiens
agccgggaggagcgggcgcgagcggggcagagcgcggcgcggggccggcggcgaaggtccggggtggaatcgacgtcgctgcggctgccgacgacccacacccggccggccgcctccgcagacccaccttggccgcgcggcagggggcgcgcagagccccgagggagcgagtccccgcgcgtggcagctcggcggcttctcccttcgggaggtccggctcccggctctccggacccgcctggcgtcctcgcctgcggcggggcggacgacagcggcgcccaggaatggcttcggcgggcagcggcatggaggaggtgcgcgtgtcggtgctgacccccttgaagctggtcgggctggtgtgcatcttcctggcgctgtgtctggacctgggggcggtgctgagcccggcctgggtcacagctgaccaccagtactacctgtcgttgtgggagtcctgccgcaaacccgccagcttggacatctggcactgcgagtccacgctcagcagcgattggcagattgctactctggctttactcctgggcggcgctgccatcattctcattgcattcctggtgggtttgatttctatctgcgtgggatctcgaaggcgtttctatagacctgttgcggtcatgctttttgcagcagttgttttacaggtttgcagcctggtcctttacccaatcaagttcattgaaactgtgagcttgaaaatttaccatgagttcaactggggttatggcctggcctggggtgcaactatattttcgtttgggggtgccatcctttattgcctgaaccctaagaactatgaagactactactagaaccaatagtctcaaagtaaaaacaaccaccaccatccaacaaaaggattacgtctgcatcttttctaacttactattttctaaaacacttgtggagcatcaagcagtttgctcagttgatttaatcttttttgccttttggctgtcaacatcataaccagcttttacatccattttagaaatctgcacaaattaagagagctgattagacataggcaaatgctgcaaacttccaatatgttcatatcgtttttcttgacaaatgaagggtctatatgacagcaaccattgtgagaaactagttggaatgagatttgcctcaatctcctattgcctgcaggggagcagttggcataagcaacatttagaagttcctttgcgctgacaaggattccactgttagagcccttaccgcctgcttatcctacccaatgactacattggctgttggttatttgcttgagtgagcccttgaaaaatgaactgcccttcagcatctaatgggagttgtgaatgtaactggttaatgatacacattccaccttcaggaacactctttttaatgggaggttatgctttggcaatcagcgtctccctgggaagagagtcaagacttggagacatgtgcttctcattatgtggttagaaattggtgcctcagccctatctagactggggaaaaattgaggatctctgtttttcctggggcaaacagaaagaaatctgcatgagttgcttttgtaccctttaaatcatttgccaaacattgcagcaaacaagtgtgcgtatgtaacaagcttcactgtttttatagaaggtgaaccattagtataaatggtaataagttgttccctaaccctccacatacatttgcctatcacacgtaaaattaatatttactctagtgaagtggtttgagcactaaccttgtacacattgttaagaggcttagattggtattcatacttatttaccatacaaaagtatggtaccttaaagcttttgctctatgttctttactgtttcactggaaagtgtcaatagagttgcctaagaataaaaattgaaatggtgttaatctgaaaattaatgattctctgtaagcactgtagttgaaaagagagtagcaattaggatgatcattttgtgtaaaattcattaaaatagaaggctgctattttttgcaagtattttaaatgtcttcatttttttaagaaaggaatagcgatagatttatataaatatctaaatgtctcagtagaggagtagaattcatctggttatcacctggtcctctgaagttaactgatgggctaaccgatttgtgcacacacttaggatggatttatgttaagggaattacttactgactgttcaatggaaggaagtattaataatagggaataagtttgcaactaatctcatgctgcaaacttgtgttaattctgtttaatatacaaatttggatagcttaattataaacatatttttatatcaaatatacagttctaatataaaagttataaataattatttttgttaacaaagacactaaaacagtatgttctggttttggccctcttgcagaaagaagcattagaaaaattactttaaaagtagctatatgttactgtattgcaaaatctgttaagagcaggaccacatcgatagtatttaataatttgttttacctcccaaaacacagttcttctttcagcttgtcttaagaatggttgccaaaaacaacagccaaaaaaaaaaaaacctattttattatccaaatgctagaaaacacacatgaattttctataaaatcacgaatatgaagtaccaggtttagtcttactttagcaatgatagacaaaagcgaataaatacatcacagacagaaacctttataaaaatatatgattctataaagaatcattagaaattatgagtggaaattctccagaaagatagtattatagagtcttttgaagcaattttttgagaaatagtaaaatctggggcagagtgtcttgcagttaattgcatattgtcagagcagcatgagaaatatgatatttggatagggatttcagcaactaaacattctctgttctgagatctctttattcctgaataatgaaagaatagtactttggtgctgacaccaatgaggcacttctcttggtcctagtagaggatgcagtgtactgttaaaccaatatcatcacatctcgagtcttatcaagttttcattctctgtcaatatgacaagctcaaagtgacagaatatgttataggttgaagcacacatatttgcagtttactgaaaagtagatttcttatgtgacttttttcccttctcagcaaagagccctacactagatttctaccatcactaatatttggaagtatttcattactaacaatctcagtacaacatgaaaattgttgcttctcatctaaaatacaattttgtctatcagaataaacacaagtgaaattttcacctacattaacattatgtctttgcagctttaggtttgttagatgtgttcttaagcataatttttagccacaaacccattgttagatagatatctatggatatagatctacatctatagatatagatatacacacatatatatactcacacacatatagcataaaatactcagcagggctagttattccgatttcttgcacaattatttagctttttgtaagttcaacatgtaatgacatgtttactacttaaacatgaattcatggtatcctggttattttttttaagtcatctgggggaaaacctgtttatcactccagtgattttgagtttgcagtttcacaatcagttcttcatttcatgatttttgtagttgacatgaagtcatctatgtggaaaaaaataaaaataaaagtgatttcacggatgtggtt

SEQ ID NO: 458221 - DNA, 3880 bp, Homo sapiens
agccgggaggagcgggcgcgagcggggcagagcgcggcgcggggccggcggcgaaggtccggggtggaatcgacgtcgctgcggctgccgacgacccacacccggccggccgcctccgcagacccaccttggccgcgcggcagggggcgcgcagagccccgagggagcgagtccccgcgcgtggcagctcggcggcttctcccttcgggaggtccggctcccggctctccggacccgcctggcgtcctcgcctgcggcggggcggacgacagcggcgcccaggaatggcttcggcgggcagcggcatggaggagattggcagattgctactctggctttactcctgggcggcgctgccatcattctcattgcattcctggtgggtttgatttctatctgcgtgggatctcgaaggcgtttctatagacctgttgcggtcatgctttttgcagcagttgttttacaggtttgcagcctggtcctttacccaatcaagttcattgaaactgtgagcttgaaaatttaccatgagttcaactggggttatggcctggcctggggtgcaactatattttcgtttgggggtgccatcctttattgcctgaaccctaagaactatgaagactactactagaaccaatagtctcaaagtaaaaacaaccaccaccatccaacaaaaggattacgtctgcatcttttctaacttactattttctaaaacacttgtggagcatcaagcagtttgctcagttgatttaatcttttttgccttttggctgtcaacatcataaccagcttttacatccattttagaaatctgcacaaattaagagagctgattagacataggcaaatgctgcaaacttccaatatgttcatatcgtttttcttgacaaatgaagggtctatatgacagcaaccattgtgagaaactagttggaatgagatttgcctcaatctcctattgcctgcaggggagcagttggcataagcaacatttagaagttcctttgcgctgacaaggattccactgttagagcccttaccgcctgcttatcctacccaatgactacattggctgttggttatttgcttgagtgagcccttgaaaaatgaactgcccttcagcatctaatgggagttgtgaatgtaactggttaatgatacacattccaccttcaggaacactctttttaatgggaggttatgctttggcaatcagcgtctccctgggaagagagtcaagacttggagacatgtgcttctcattatgtggttagaaattggtgcctcagccctatctagactggggaaaaattgaggatctctgtttttcctggggcaaacagaaagaaatctgcatgagttgcttttgtaccctttaaatcatttgccaaacattgcagcaaacaagtgtgcgtatgtaacaagcttcactgtttttatagaaggtgaaccattagtataaatggtaataagttgttccctaaccctccacatacatttgcctatcacacgtaaaattaatatttactctagtgaagtggtttgagcactaaccttgtacacattgttaagaggcttagattggtattcatacttatttaccatacaaaagtatggtaccttaaagcttttgctctatgttctttactgtttcactggaaagtgtcaatagagttgcctaagaataaaaattgaaatggtgttaatctgaaaattaatgattctctgtaagcactgtagttgaaaagagagtagcaattaggatgatcattttgtgtaaaattcattaaaatagaaggctgctattttttgcaagtattttaaatgtcttcatttttttaagaaaggaatagcgatagatttatataaatatctaaatgtctcagtagaggagtagaattcatctggttatcacctggtcctctgaagttaactgatgggctaaccgatttgtgcacacacttaggatggatttatgttaagggaattacttactgactgttcaatggaaggaagtattaataatagggaataagtttgcaactaatctcatgctgcaaacttgtgttaattctgtttaatatacaaatttggatagcttaattataaacatatttttatatcaaatatacagttctaatataaaagttataaataattatttttgttaacaaagacactaaaacagtatgttctggttttggccctcttgcagaaagaagcattagaaaaattactttaaaagtagctatatgttactgtattgcaaaatctgttaagagcaggaccacatcgatagtatttaataatttgttttacctcccaaaacacagttcttctttcagcttgtcttaagaatggttgccaaaaacaacagccaaaaaaaaaaaaacctattttattatccaaatgctagaaaacacacatgaattttctataaaatcacgaatatgaagtaccaggtttagtcttactttagcaatgatagacaaaagcgaataaatacatcacagacagaaacctttataaaaatatatgattctataaagaatcattagaaattatgagtggaaattctccagaaagatagtattatagagtcttttgaagcaattttttgagaaatagtaaaatctggggcagagtgtcttgcagttaattgcatattgtcagagcagcatgagaaatatgatatttggatagggatttcagcaactaaacattctctgttctgagatctctttattcctgaataatgaaagaatagtactttggtgctgacaccaatgaggcacttctcttggtcctagtagaggatgcagtgtactgttaaaccaatatcatcacatctcgagtcttatcaagttttcattctctgtcaatatgacaagctcaaagtgacagaatatgttataggttgaagcacacatatttgcagtttactgaaaagtagatttcttatgtgacttttttcccttctcagcaaagagccctacactagatttctaccatcactaatatttggaagtatttcattactaacaatctcagtacaacatgaaaattgttgcttctcatctaaaatacaattttgtctatcagaataaacacaagtgaaattttcacctacattaacattatgtctttgcagctttaggtttgttagatgtgttcttaagcataatttttagccacaaacccattgttagatagatatctatggatatagatctacatctatagatatagatatacacacatatatatactcacacacatatagcataaaatactcagcagggctagttattccgatttcttgcacaattatttagctttttgtaagttcaacatgtaaattttaaagacataaatatagagagacttatgtgtttgaatataaatgatatatatggattagcatgtacctgtatattattaaacatgcaatgaactgactggtaagtgacgtctaattgtatggctagcaatgtaatttattcagactgtatttttgtacagagcagtgcactctaacctatgcctctgtgtcctctttaatgcctaaagctgtgcctagaaatttcatctgtcttaaaagtaaaatatacttcatgctgtttatgctattagtttctgtactgctattctatatttattatttttaaatatatgacatgtttactacttaaacatgaattcatggtatcctggttattttttttaagtcatctgggggaaaacctgtttatcactccagtgattttgagtttgcagtttcacaatcagttcttcatttcatgatttttgtagttgacatgaagtcatctatgtggaaaaaaataaaaataaaagtgatttcacggatgtggtt

SEQ ID NO: 458222 - DNA, 4032 bp, Homo sapiens
  misc_feature (4018)..(4018): n is a, c, g, or t
agccgggaggagcgggcgcgagcggggcagagcgcggcgcggggccggcggcgaaggtccggggtggaatcgacgtcgctgcggctgccgacgacccacacccggccggccgcctccgcagacccaccttggccgcgcggcagggggcgcgcagagccccgagggagcgagtccccgcgcgtggcagctcggcggcttctcccttcgggaggtccggctcccggctctccggacccgcctggcgtcctcgcctgcggcggggcggacgacagcggcgcccaggaatggcttcggcgggcagcggcatggaggaggtgcgcgtgtcggtgctgacccccttgaagctggtcgggctggtgtgcatcttcctggcgctgtgtctggacctgggggcggtgctgagcccggcctgggtcacagctgaccaccagtactacctgtcgttgtgggagtcctgccgcaaacccgccagcttggacatctggcactgcgagtccacgctcagcagcgattggcagattgctactctggctttactcctgggcggcgctgccatcattctcattgcattcctggtgggtttgatttctatctgcgtgggatctcgaaggcgtttctatagacctgttgcggtcatgctttttgcagcagttgttttacaggtttgcagcctggtcctttacccaatcaagttcattgaaactgtgagcttgaaaatttaccatgagttcaactggggttatggcctggcctggggtgcaactatattttcgtttgggggtgccatcctttattgcctgaaccctaagaactatgaagactactactagaaccaatagtctcaaagtaaaaacaaccaccaccatccaacaaaaggattacgtctgcatcttttctaacttactattttctaaaacacttgtggagcatcaagcagtttgctcagttgatttaatcttttttgccttttggctgtcaacatcataaccagcttttacatccattttagaaatctgcacaaattaagagagctgattagacataggcaaatgctgcaaacttccaatatgttcatatcgtttttcttgacaaatgaagggtctatatgacagcaaccattgtgagaaactagttggaatgagatttgcctcaatctcctattgcctgcaggggagcagttggcataagcaacatttagaagttcctttgcgctgacaaggattccactgttagagcccttaccgcctgcttatcctacccaatgactacattggctgttggttatttgcttgagtgagcccttgaaaaatgaactgcccttcagcatctaatgggagttgtgaatgtaactggttaatgatacacattccaccttcaggaacactctttttaatgggaggttatgctttggcaatcagcgtctccctgggaagagagtcaagacttggagacatgtgcttctcattatgtggttagaaattggtgcctcagccctatctagactggggaaaaattgaggatctctgtttttcctggggcaaacagaaagaaatctgcatgagttgcttttgtaccctttaaatcatttgccaaacattgcagcaaacaagtgtgcgtatgtaacaagcttcactgtttttatagaaggtgaaccattagtataaatggtaataagttgttccctaaccctccacatacatttgcctatcacacgtaaaattaatatttactctagtgaagtggtttgagcactaaccttgtacacattgttaagaggcttagattggtattcatacttatttaccatacaaaagtatggtaccttaaagcttttgctctatgttctttactgtttcactggaaagtgtcaatagagttgcctaagaataaaaattgaaatggtgttaatctgaaaattaatgattctctgtaagcactgtagttgaaaagagagtagcaattaggatgatcattttgtgtaaaattcattaaaatagaaggctgctattttttgcaagtattttaaatgtcttcatttttttaagaaaggaatagcgatagatttatataaatatctaaatgtctcagtagaggagtagaattcatctggttatcacctggtcctctgaagttaactgatgggctaaccgatttgtgcacacacttaggatggatttatgttaagggaattacttactgactgttcaatggaaggaagtattaataatagggaataagtttgcaactaatctcatgctgcaaacttgtgttaattctgtttaatatacaaatttggatagcttaattataaacatatttttatatcaaatatacagttctaatataaaagttataaataattatttttgttaacaaagacactaaaacagtatgttctggttttggccctcttgcagaaagaagcattagaaaaattactttaaaagtagctatatgttactgtattgcaaaatctgttaagagcaggaccacatcgatagtatttaataatttgttttacctcccaaaacacagttcttctttcagcttgtcttaagaatggttgccaaaaacaacagccaaaaaaaaaaaaacctattttattatccaaatgctagaaaacacacatgaattttctataaaatcacgaatatgaagtaccaggtttagtcttactttagcaatgatagacaaaagcgaataaatacatcacagacagaaacctttataaaaatatatgattctataaagaatcattagaaattatgagtggaaattctccagaaagatagtattatagagtcttttgaagcaattttttgagaaatagtaaaatctggggcagagtgtcttgcagttaattgcatattgtcagagcagcatgagaaatatgatatttggatagggatttcagcaactaaacattctctgttctgagatctctttattcctgaataatgaaagaatagtactttggtgctgacaccaatgaggcacttctcttggtcctagtagaggatgcagtgtactgttaaaccaatatcatcacatctcgagtcttatcaagttttcattctctgtcaatatgacaagctcaaagtgacagaatatgttataggttgaagcacacatatttgcagtttactgaaaagtagatttcttatgtgacttttttcccttctcagcaaagagccctacactagatttctaccatcactaatatttggaagtatttcattactaacaatctcagtacaacatgaaaattgttgcttctcatctaaaatacaattttgtctatcagaataaacacaagtgaaattttcacctacattaacattatgtctttgcagctttaggtttgttagatgtgttcttaagcataatttttagccacaaacccattgttagatagatatctatggatatagatctacatctatagatatagatatacacacatatatatactcacacacatatagcataaaatactcagcagggctagttattccgatttcttgcacaattatttagctttttgtaagttcaacatgtaaattttaaagacataaatatagagagacttatgtgtttgaatataaatgatatatatggattagcatgtacctgtatattattaaacatgcaatgaactgactggtaagtgacgtctaattgtatggctagcaatgtaatttattcagactgtatttttgtacagagcagtgcactctaacctatgcctctgtgtcctctttaatgcctaaagctgtgcctagaaatttcatctgtcttaaaagtaaaatatacttcatgctgtttatgctattagtttctgtactgctattctatatttattatttttaaatataacatgatctgggatcggtattcgtagtcacgggaaacgtgtaccaggatgatgagcccacggcctcgcatggggcgagcctggaataccagtcgcaaccgggggccccaggatcgggacgggagcacgccgggcccgcgttancaaccacacacacc

SEQ ID NO: 458223 - DNA, 1017 bp, Homo sapiens
gagtccgtcgtgctcaggggcgggcggaacgggctgacggacgcggctatgggccagtgtgagcggcgagtgggacgtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtat

SEQ ID NO: 458224 - DNA, 671 bp, Homo sapiens
ttatcttggaagctgaatcgcctgagcacaaagatgagaaagtcattgcctatcttcccctcatgagcccctttcctcacagttggtgtttctgacaaactctctgacttctgttcaccagctgctctgctcctgggagtagcaaagttcttcactggagagggtctggattgcctgtctttgtctctgatgggctttgggaacagacagcatcctgggcagaatggtcccatctcaaatctgcatctggcatggaataagaaaaccttgctaacagtcccagcctttcattgctgtcttcctgttctcagatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtat

SEQ ID NO: 458225 - DNA, 7354 bp, Homo sapiens
  misc_feature (6646)..(6646): n is a, c, g, or t
  misc_feature (6651)..(6651): n is a, c, g, or t
  misc_feature (6716)..(6716): n is a, c, g, or t
  misc_feature (7222)..(7222): n is a, c, g, or t
gagtccgtcgtgctcaggggcgggcggaacgggctgacggacgcggctatgggccagtgtgagcggcgagtgggacgtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtatctttggcgtgtgtgctactctcatctgtgtgtatgtgtgttgtgtgtgtgtgtgtgtgcatgcacatatgtgttcactctgctactttgtaagttttaggctaggttgctttaccagctgtttacttcttttttgttgttgttttgagacaaggtttcgctctgccaccctggctggagtgcagtggcgtgatcttggctcacggcaacctctgcctcctggggctcaagcaattatcccacctcagcctcctgagcagctgggactacaggtgcatgccacaacacctggctgatatttgtattttttgtagagacaggattttgccaagttgcccaggctggtcttgaactcctaggcttaagcaatccacccaccttggcctcctgaagtgccaggatcacagacgtgagccactacacccagcccagctgtttacttctttaaccatacttttgattttattttttgaccaaaatgaactaacccaggtaatcttccagggaccgcaattccagaacctcatagtatttcttccatttccagcagctgattagaagtccaggatcatgtgaagtcaggcagggtcacagttcctgatggcacattatggacagagaattccattttgttttctaacccatgatgaaaacccacgtgagtcagtgtgtgaacagggatcattaattttttccccctaggtggaaggaaaaaggcacttactttgcaggttacagaaattactgggagaggatatcgtcataaaaagagccaggccaaattggaatatttttgtgatctgcatcatgatgctgaaaatagcaattatttgggaattgggtttgaaaactgaattgttgccagagaattaaaccaggtgaaaggtccttttgaattcagattgtcttctgaacatccaggctgatcatctgagagcagtcaaatctacttccccaaaaagagaccagggtaggtttatttgcttttatttttaatgtttgcctgtgtttccaagtgtgaacaaaacagtgtgtgatctattcttggattcattttgatcagtatttattcaaacccagtctctctccaggacataaaactgaaatcagatatgttctttttaagcccaaaccctctcctttctagatccaaccttcacccctaattttatgatggctatagccatggacttccccaagaaaagatcacccagaaataagaccacctgtgacagttaccagcttttattcataaccttagcttcccaactattgagcattttctaaggtccctgctgtcttttggtctctggtttgatttgtggcaaacagatgaagtaacagactgctatgaaggaccacaaaaacggcagcctctggaaaaaccattagaaagtcagtggcagatccagtaaataatatcgccagcctcagcataatctgctgctgactcgattcagtggactctaaagtgcccagcctcctgacctgagctctcctgccatctgtgagactaccagaggtcttatctgctgtccacatggcaactgggcatgagtacctggccaccttgcttccctctttgcctggtccaagtgagtgtctgctgcctctgtcctgccttgttttcctggctctaaaccaactccacccactcttaatggaaactcagtctggctttgtgtgtttctgggaagcacatgacttctgggaatgggcaaggaagaggagtgaaacaaaaactgtcagctatgtgtgcctggtctgggatccttctctgggtgacagtggcatcatgaatcttagaatcagctcccctttaactagggacaattgtaagcacttggcctcaaagttgaggttcttgaatgtttgctaattttatgtgcatgatccttgcccaaatatttgtcatccgtccacatagattcacgtgtgcatacaacatgtacaagtaatatttgggctgcccataagaactggaagattcatagggaatgcatatacccttctcagtatggttaggattctgtttttgcttcatttaattccagagttcctcagcctcagcaggttctgcttttacctgtcacagaaatgtccagtgtttaatgcatttggttgctggggcttacatgccagcctcctctgatatgtacttggtttttaaaaacccattttgttctctcttgtttcctctctatttccctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgagaggttctgcatgcattatctcatttattctcctcgataaccctgtggaggtaagtattgctattatctctatggtatgtctgtagactttgagattcagacatctgataatggcagaaccagagcctgagtccaagtctggctccacaccccagcctcttaacactgtgccaattgctttgacactttgctggggagagatgaaatgatctcaaaggcactcatgatacagaaaaggctatgagccatggatccaaacaaaaggagaaactcaagtaggtttgctctgttacagtgaaggacctgccacaggtaagacctttttctattttgccatcctccgttgtttccttattgttggtactaaagttccaatgtgctggatttgcatagctcctggaatcacccgtattccagaaaggctggaggggtgagttatgttgggggaaggagccggttcccatctcttgtcctccacgattatctcctggttctggataaggtggccaggagagggtgtgtatgtaggctgttgagtcacaggcagccgtctcagattgcagctctgtgtagcngatgntgttgcattattcataactccagggggagcagtgtgcttctgatgttttgggaatgcagcagctntgggtttagagtcatccatggcagtgtgatgatgagctgctctcacagagggccccttccaggtgcccagtccagattgaggtgcccccagcagaaaacaggtggaaatggaaagacagagcatcagagggcaagacaacatgggcctagatcctgtgcaggtagccctcaagccaataagccaaacagatctgcactttgggggtaaagttgctatggagcaaataatttgattgtgtggtgttctgtaagggttttgcagacaaattcctctgagcttagctaggagttcattatgcttcctgtttagctggtcttctttcttctactaaataagaaatgcttcatttttggccgagcacggtggctcatgcctgtaatctcagcactttgggaggccggggcatgcggatcacaaggtcaggagtttgagaccagcctggccaacgtggtgaaaccccgtctctactaaagatacaaaaaaatcagctgggcatggtggcgcncacctgtaatcgcaactatttgggagttcgaggcaggagaattgcttgaacccgggaggcggaggttgcagtgagccgagatcgcgccattgcactccagcctgggcaacagggtaaggctccgtctcaaga

SEQ ID NO: 458226 - DNA, 6073 bp, Homo sapiens
gagtccgtcgtgctcaggggcgggcggaacgggctgacggacgcggctatgggccagtgtgagcggcgagtgggacgtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtatctttggcgtgtgtgctactctcatctgtgtgtatgtgtgttgtgtgtgtgtgtgtgtgcatgcacatatgtgttcactctgctactttgtaagttttaggctaggttgctttaccagctgtttacttcttttttgttgttgttttgagacaaggtttcgctctgccaccctggctggagtgcagtggcgtgatcttggctcacggcaacctctgcctcctggggctcaagcaattatcccacctcagcctcctgagcagctgggactacaggtgcatgccacaacacctggctgatatttgtattttttgtagagacaggattttgccaagttgcccaggctggtcttgaactcctaggcttaagcaatccacccaccttggcctcctgaagtgccaggatcacagacgtgagccactacacccagcccagctgtttacttctttaaccatacttttgattttattttttgaccaaaatgaactaacccaggtaatcttccagggaccgcaattccagaacctcatagtatttcttccatttccagcagctgattagaagtccaggatcatgtgaagtcaggcagggtcacagttcctgatggcacattatggacagagaattccattttgttttctaacccatgatgaaaacccacgtgagtcagtgtgtgaacagggatcattaattttttccccctaggtggaaggaaaaaggcacttactttgcaggttacagaaattactgggagaggatatcgtcataaaaagagccaggccaaattggaatatttttgtgatctgcatcatgatgctgaaaatagcaattatttgggaattgggtttgaaaactgaattgttgccagagaattaaaccaggtgaaaggtccttttgaattcagattgtcttctgaacatccaggctgatcatctgagagcagtcaaatctacttccccaaaaagagaccagggtaggtttatttgcttttatttttaatgtttgcctgtgtttccaagtgtgaacaaaacagtgtgtgatctattcttggattcattttgatcagtatttattcaaacccagtctctctccaggacataaaactgaaatcagatatgttctttttaagcccaaaccctctcctttctagatccaaccttcacccctaattttatgatggctatagccatggacttccccaagaaaagatcacccagaaataagaccacctgtgacagttaccagcttttattcataaccttagcttcccaactattgagcattttctaaggtccctgctgtcttttggtctctggtttgatttgtggcaaacagatgaagtaacagactgctatgaaggaccacaaaaacggcagcctctggaaaaaccattagaaagtcagtggcagatccagtaaataatatcgccagcctcagcataatctgctgctgactcgattcagtggactctaaagtgcccagcctcctgacctgagctctcctgccatctgtgagactaccagaggtcttatctgctgtccacatggcaactgggcatgagtacctggccaccttgcttccctctttgcctggtccaagtgagtgtctgctgcctctgtcctgccttgttttcctggctctaaaccaactccacccactcttaatggaaactcagtctggctttgtgtgtttctgggaagcacatgacttctgggaatgggcaaggaagaggagtgaaacaaaaactgtcagctatgtgtgcctggtctgggatccttctctgggtgacagtggcatcatgaatcttagaatcagctcccctttaactagggacaattgtaagcacttggcctcaaagttgaggttcttgaatgtttgctaattttatgtgcatgatccttgcccaaatatttgtcatccgtccacatagattcacgtgtgcatacaacatgtacaagtaatatttgggctgcccataagaactggaagattcatagggaatgcatatacccttctcagtatggttaggattctgtttttgcttcatttaattccagagttcctcagcctcagcaggttctgcttttacctgtcacagaaatgtccagtgtttaatgcatttggttgctggggcttacatgccagcctcctctgatatgtacttggtttttaaaaacccattttgttctctcttgtttcctctctatttccctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgaga

SEQ ID NO: 458227 - DNA, 5174 bp, Homo sapiens
gagtccgtcgtgctcaggggcgggcggaacgggctgacggacgcggctatgggccagtgtgagcggcgagtgggacgtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtatctttggcgtgtgtgctactctcatctgtgtgtatgtgtgttgtgtgtgtgtgtgtgtgcatgcacatatgtgttcactctgctactttgtaagttttaggctaggttgctttaccagctgtttacttcttttttgttgttgttttgagacaaggtttcgctctgccaccctggctggagtgcagtggcgtgatcttggctcacggcaacctctgcctcctggggctcaagcaattatcccacctcagcctcctgagcagctgggactacaggtgcatgccacaacacctggctgatatttgtattttttgtagagacaggattttgccaagttgcccaggctggtcttgaactcctaggcttaagcaatccacccaccttggcctcctgaagtgccaggatcacagacgtgagccactacacccagcccagctgtttacttctttaaccatacttttgattttattttttgaccaaaatgaactaacccaggtaatcttccagggaccgcaattccagaacctcatagtatttcttccatttccagcagctgattagaagtccaggatcatgtgaagtcaggcagggtcacagttcctgatggcacattatggacagagaattccattttgttttctaacccatgatgaaaacccacgtgagtcagtgtgtgaacagggatcattaattttttccccctaggtggaaggaaaaaggcacttactttgcaggttacagaaattactgggagaggatatcgtcataaaaagagccaggccaaattggaatatttttgtgatctgcatcatgatgctgaaaatagcaattatttgggaattgggtttgaaaactgaattgttgccagagaattaaaccaggtgaaaggtccttttgaattcagattgtcttctgaacatccaggctgatcatctgagagcagtcaaatctacttccccaaaaagagaccagggtaggtttatttgcttttatttttaatgtttgcctgtgtttccaagtgtgaacaaaacagtgtgtgatctattcttggattcattttgatcagtatttattcaaacccagtctctctccaggacataaaactgaaatcagatatgttctttttaagcccaaaccctctcctttctagatccaaccttcacccctaattttatgatggctatagccatggacttccccaagaaaagatcacccagaaataagaccacctgtgacagttaccagcttttattcataaccttagcttcccaactattgagcattttctaaggtccctgctgtcttttggtctctggtttgatttgtggcaaacagatgaagtaacagactgctatgaaggaccacaaaaacggcagcctctggaaaaaccattagaaagtcagtggcagatccagtaaataatatcgccagcctcagcataatctgctgctgactcgattcagtggactctaaagtgcccagcctcctgacctgagctctcctgccatctgtgagactaccagaggtcttatctgctgtccacatggcaactgggcatgagtacctggccaccttgcttccctctttgcctggtccaagtgagtgtctgctgcctctgtcctgccttgttttcctggctctaaaccaactccacccactcttaatggaaactcagtctggctttgtgtgtttctgggaagcacatgacttctgggaatgggcaaggaagaggagtgaaacaaaaactgtcagctatgtgtgcctggtctgggatccttctctgggtgacagtggcatcatgaatcttagaatcagctcccctttaactagggacaattgtaagcacttggcctcaaagttgaggttcttgaatgtttgctaattttatgtgcatgatccttgcccaaatatttgtcatccgtccacatagattcacgtgtgcatacaacatgtacaagtaatatttgggctgcccataagaactggaagattcatagggaatgcatatacccttctcagtatggttaggattctgtttttgcttcatttaattccagagttcctcagcctcagcaggttctgcttttacctgtcacagaaatgtccagtgtttaatgcatttggttgctggggcttacatgccagcctcctctgatatgtacttggtttttaaaaacccattttgttctctcttgtttcctctctatttccctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactggg

SEQ ID NO: 458228 - DNA, 7161 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
  misc_feature (6453)..(6453): n is a, c, g, or t
  misc_feature (6458)..(6458): n is a, c, g, or t
  misc_feature (6523)..(6523): n is a, c, g, or t
  misc_feature (7029)..(7029): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtatctttggcgtgtgtgctactctcatctgtgtgtatgtgtgttgtgtgtgtgtgtgtgtgcatgcacatatgtgttcactctgctactttgtaagttttaggctaggttgctttaccagctgtttacttcttttttgttgttgttttgagacaaggtttcgctctgccaccctggctggagtgcagtggcgtgatcttggctcacggcaacctctgcctcctggggctcaagcaattatcccacctcagcctcctgagcagctgggactacaggtgcatgccacaacacctggctgatatttgtattttttgtagagacaggattttgccaagttgcccaggctggtcttgaactcctaggcttaagcaatccacccaccttggcctcctgaagtgccaggatcacagacgtgagccactacacccagcccagctgtttacttctttaaccatacttttgattttattttttgaccaaaatgaactaacccaggtaatcttccagggaccgcaattccagaacctcatagtatttcttccatttccagcagctgattagaagtccaggatcatgtgaagtcaggcagggtcacagttcctgatggcacattatggacagagaattccattttgttttctaacccatgatgaaaacccacgtgagtcagtgtgtgaacagggatcattaattttttccccctaggtggaaggaaaaaggcacttactttgcaggttacagaaattactgggagaggatatcgtcataaaaagagccaggccaaattggaatatttttgtgatctgcatcatgatgctgaaaatagcaattatttgggaattgggtttgaaaactgaattgttgccagagaattaaaccaggtgaaaggtccttttgaattcagattgtcttctgaacatccaggctgatcatctgagagcagtcaaatctacttccccaaaaagagaccagggtaggtttatttgcttttatttttaatgtttgcctgtgtttccaagtgtgaacaaaacagtgtgtgatctattcttggattcattttgatcagtatttattcaaacccagtctctctccaggacataaaactgaaatcagatatgttctttttaagcccaaaccctctcctttctagatccaaccttcacccctaattttatgatggctatagccatggacttccccaagaaaagatcacccagaaataagaccacctgtgacagttaccagcttttattcataaccttagcttcccaactattgagcattttctaaggtccctgctgtcttttggtctctggtttgatttgtggcaaacagatgaagtaacagactgctatgaaggaccacaaaaacggcagcctctggaaaaaccattagaaagtcagtggcagatccagtaaataatatcgccagcctcagcataatctgctgctgactcgattcagtggactctaaagtgcccagcctcctgacctgagctctcctgccatctgtgagactaccagaggtcttatctgctgtccacatggcaactgggcatgagtacctggccaccttgcttccctctttgcctggtccaagtgagtgtctgctgcctctgtcctgccttgttttcctggctctaaaccaactccacccactcttaatggaaactcagtctggctttgtgtgtttctgggaagcacatgacttctgggaatgggcaaggaagaggagtgaaacaaaaactgtcagctatgtgtgcctggtctgggatccttctctgggtgacagtggcatcatgaatcttagaatcagctcccctttaactagggacaattgtaagcacttggcctcaaagttgaggttcttgaatgtttgctaattttatgtgcatgatccttgcccaaatatttgtcatccgtccacatagattcacgtgtgcatacaacatgtacaagtaatatttgggctgcccataagaactggaagattcatagggaatgcatatacccttctcagtatggttaggattctgtttttgcttcatttaattccagagttcctcagcctcagcaggttctgcttttacctgtcacagaaatgtccagtgtttaatgcatttggttgctggggcttacatgccagcctcctctgatatgtacttggtttttaaaaacccattttgttctctcttgtttcctctctatttccctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgagaggttctgcatgcattatctcatttattctcctcgataaccctgtggaggtaagtattgctattatctctatggtatgtctgtagactttgagattcagacatctgataatggcagaaccagagcctgagtccaagtctggctccacaccccagcctcttaacactgtgccaattgctttgacactttgctggggagagatgaaatgatctcaaaggcactcatgatacagaaaaggctatgagccatggatccaaacaaaaggagaaactcaagtaggtttgctctgttacagtgaaggacctgccacaggtaagacctttttctattttgccatcctccgttgtttccttattgttggtactaaagttccaatgtgctggatttgcatagctcctggaatcacccgtattccagaaaggctggaggggtgagttatgttgggggaaggagccggttcccatctcttgtcctccacgattatctcctggttctggataaggtggccaggagagggtgtgtatgtaggctgttgagtcacaggcagccgtctcagattgcagctctgtgtagcngatgntgttgcattattcataactccagggggagcagtgtgcttctgatgttttgggaatgcagcagctntgggtttagagtcatccatggcagtgtgatgatgagctgctctcacagagggccccttccaggtgcccagtccagattgaggtgcccccagcagaaaacaggtggaaatggaaagacagagcatcagagggcaagacaacatgggcctagatcctgtgcaggtagccctcaagccaataagccaaacagatctgcactttgggggtaaagttgctatggagcaaataatttgattgtgtggtgttctgtaagggttttgcagacaaattcctctgagcttagctaggagttcattatgcttcctgtttagctggtcttctttcttctactaaataagaaatgcttcatttttggccgagcacggtggctcatgcctgtaatctcagcactttgggaggccggggcatgcggatcacaaggtcaggagtttgagaccagcctggccaacgtggtgaaaccccgtctctactaaagatacaaaaaaatcagctgggcatggtggcgcncacctgtaatcgcaactatttgggagttcgaggcaggagaattgcttgaacccgggaggcggaggttgcagtgagccgagatcgcgccattgcactccagcctgggcaacagggtaaggctccgtctcaaga

SEQ ID NO: 458229 - DNA, 5575 bp, Homo sapiens
  misc_feature (4867)..(4867): n is a, c, g, or t
  misc_feature (4872)..(4872): n is a, c, g, or t
  misc_feature (4937)..(4937): n is a, c, g, or t
  misc_feature (5443)..(5443): n is a, c, g, or t
gcatgttctccaggtgcaggctgaaccctgggacagtgacatttttcatccaagggccttcgtaatagcttaatgtttgaattgaacccctggggttgccagagaattaaaccaggtgaaaggtccttttgaattcagattgtcttctgaacatccaggctgatcatctgagagcagtcaaatctacttccccaaaaagagaccagggtaggtttatttgcttttatttttaatgtttgcctgtgtttccaagtgtgaacaaaacagtgtgtgatctattcttggattcattttgatcagtatttattcaaacccagtctctctccaggacataaaactgaaatcagatatgttctttttaagcccaaaccctctcctttctagatccaaccttcacccctaattttatgatggctatagccatggacttccccaagaaaagatcacccagaaataagaccacctgtgacagttaccagcttttattcataaccttagcttcccaactattgagcattttctaaggtccctgctgtcttttggtctctggtttgatttgtggcaaacagatgaagtaacagactgctatgaaggaccacaaaaacggcagcctctggaaaaaccattagaaagtcagtggcagatccagtaaataatatcgccagcctcagcataatctgctgctgactcgattcagtggactctaaagtgcccagcctcctgacctgagctctcctgccatctgtgagactaccagaggtcttatctgctgtccacatggcaactgggcatgagtacctggccaccttgcttccctctttgcctggtccaagtgagtgtctgctgcctctgtcctgccttgttttcctggctctaaaccaactccacccactcttaatggaaactcagtctggctttgtgtgtttctgggaagcacatgacttctgggaatgggcaaggaagaggagtgaaacaaaaactgtcagctatgtgtgcctggtctgggatccttctctgggtgacagtggcatcatgaatcttagaatcagctcccctttaactagggacaattgtaagcacttggcctcaaagttgaggttcttgaatgtttgctaattttatgtgcatgatccttgcccaaatatttgtcatccgtccacatagattcacgtgtgcatacaacatgtacaagtaatatttgggctgcccataagaactggaagattcatagggaatgcatatacccttctcagtatggttaggattctgtttttgcttcatttaattccagagttcctcagcctcagcaggttctgcttttacctgtcacagaaatgtccagtgtttaatgcatttggttgctggggcttacatgccagcctcctctgatatgtacttggtttttaaaaacccattttgttctctcttgtttcctctctatttccctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgagaggttctgcatgcattatctcatttattctcctcgataaccctgtggaggtaagtattgctattatctctatggtatgtctgtagactttgagattcagacatctgataatggcagaaccagagcctgagtccaagtctggctccacaccccagcctcttaacactgtgccaattgctttgacactttgctggggagagatgaaatgatctcaaaggcactcatgatacagaaaaggctatgagccatggatccaaacaaaaggagaaactcaagtaggtttgctctgttacagtgaaggacctgccacaggtaagacctttttctattttgccatcctccgttgtttccttattgttggtactaaagttccaatgtgctggatttgcatagctcctggaatcacccgtattccagaaaggctggaggggtgagttatgttgggggaaggagccggttcccatctcttgtcctccacgattatctcctggttctggataaggtggccaggagagggtgtgtatgtaggctgttgagtcacaggcagccgtctcagattgcagctctgtgtagcngatgntgttgcattattcataactccagggggagcagtgtgcttctgatgttttgggaatgcagcagctntgggtttagagtcatccatggcagtgtgatgatgagctgctctcacagagggccccttccaggtgcccagtccagattgaggtgcccccagcagaaaacaggtggaaatggaaagacagagcatcagagggcaagacaacatgggcctagatcctgtgcaggtagccctcaagccaataagccaaacagatctgcactttgggggtaaagttgctatggagcaaataatttgattgtgtggtgttctgtaagggttttgcagacaaattcctctgagcttagctaggagttcattatgcttcctgtttagctggtcttctttcttctactaaataagaaatgcttcatttttggccgagcacggtggctcatgcctgtaatctcagcactttgggaggccggggcatgcggatcacaaggtcaggagtttgagaccagcctggccaacgtggtgaaaccccgtctctactaaagatacaaaaaaatcagctgggcatggtggcgcncacctgtaatcgcaactatttgggagttcgaggcaggagaattgcttgaacccgggaggcggaggttgcagtgagccgagatcgcgccattgcactccagcctgggcaacagggtaaggctccgtctcaaga

SEQ ID NO: 458230 - DNA, 3460 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgaga

SEQ ID NO: 458231 - DNA, 2937 bp, Homo sapiens
ttcaacggtatcgataagcttgatcagacagccggacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgaga

SEQ ID NO: 458232 - DNA, 3819 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgctgatcatctgagagcagtcaaatctacttccccaaaaagagaccaggaagtaacagactgctatgaaggaccacaaaaacggcagcctctggaaaaaccattagaaagtcagtggcagatccagtaaataatatcgccagcctcagcataatctgctgctgactcgattcagtggactctaaagtgcccagcctcctgacctgagctctcctgccatctgtgagactaccagaggtcttatctgctgtccacatggcaactgggcatgagtacctggccaccttgcttccctctttgcctggtccaacctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgaga

SEQ ID NO: 458233 - DNA, 2283 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttccctgagctttttaaataccctgtgaaaattttctttcctcccttggtcatcatgcatctaattgtggggaaatgtttgtcaaaccaacctgcaaagcagcatggtgtagttgagaagaataaacagagaagactggg

SEQ ID NO: 458234 - DNA, 2446 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaatgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccaatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactggg

SEQ ID NO: 458235 - DNA, 1572 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttg

SEQ ID NO: 458236 - DNA, 1034 bp, Homo sapiens
gagtccgtcgtgctcaggggcgggcggaacgggctgacggacgcggctatgggccagtgtgagcggcgagtgggacgtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgaccgtatgtaaactcaggacaaaaaatttccttttctttccttcccctttcttcactgtttttctttttcctttattctttccatcttccttttatttctaccaatattactaacttagtcatgaaaaataacactatcaagtaaatcacatggcctgtgtcagatctattcagtgtctcctcaggtggtttattgcttggcctcaaggttgcttccagtggtgctagctttttgcagtgcccagattgtacctgtcttctgtcaagagcagccccttttctggcatcatggccacctaagtgatcagctaatcaggagaagctttcttaaaagcctacaattggagagtgggaagagtgtggcactgaagagaagttt

SEQ ID NO: 458237 - DNA, 3746 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtatctttggcgtgtgtgctactctcatctgtgtgtatgtgtgttgtgtgtgtgtgtgtgtgcatgcacatatgtgttcactctgctactttgtaagttttaggctaggttgctttaccagctgtttacttcttttttgttgttgttttgagacaaggtttcgctctgccaccctggctggagtgcagtggcgtgatcttggctcacggcaacctctgcctcctggggctcaagcaattatcccacctcagcctcctgagcagctgggactacaggtgcatgccacaacacctggctgatatttgtattttttgtagagacaggattttgccaagttgcccaggctggtcttgaactcctaggcttaagcaatccacccaccttggcctcctgaagtgccaggatcacagacgtgagccactacacccagcccagctgtttacttctttaaccatacttttgattttattttttgaccaaaatgaactaacccaggtaatcttccagggaccgcaattccagaacctcatagtatttcttccatttccagcagctgattagaagtccaggatcatgtgaagtcaggcagggtcacagttcctgatggcacattatggacagagaattccattttgttttctaacccatgatgaaaacccacgtgagtcagtgtgtgaacagggatcattaattttttccccctaggtggaaggaaaaaggcacttactttgcaggttacagaaattactgggagaggatatcgtcataaaaagagccaggccaaattggaatatttttgtgatctgcatcatgatgctgaaaatagcaattatttgggaattgggtttgaaaactgaattgttgccagagaattaaaccaggtgaaaggtccttttgaattcagattgtcttctgaacatccaggctgatcatctgagagcagtcaaatctacttccccaaaaagagaccagggtaggtttatttgcttttatttttaatgtttgcctgtgtttccaagtgtgaacaaaacagtgtgtgatctattcttggattcattttgatcagtatttattcaaacccagtctctctccaggacataaaactgaaatcagatatgttctttttaagcccaaaccctctcctttctagatccaaccttcacccctaattttatgatggctatagccatggacttccccaagaaaagatcacccagaaataagaccacctgtgacagttaccagcttttattcataaccttagcttcccaactattgagcattttctaaggtccctgctgtcttttggtctctggtttgatttgtggcaaacagatgaagtaacagactgctatgaaggaccacaaaaacggcagcctctggaaaaaccattagaaagtcagtggcagatccagtaaataatatcgccagcctcagcataatctgctgctgactcgattcagtggactctaaagtgcccagcctcctgacctgagctctcctgccatctgtgagactaccagaggtcttatctgctgtccacatggcaactgggcatgagtacctggccaccttgcttccctctttgcctggtccaagtgagtgtctgctgcctctgtcctgccttgttttcctggctctaaaccaactccacccactcttaatggaaactcagtctggctttgtgtgtttctgggaagcacatgacttctgggaatgggcaaggaagaggagtgaaacaaaaactgtcagctatgtgtgcctggtctgggatccttctctgggtgacagtggcatcatgaatcttagaatcagctcccctttaactagggacaattgtaagcacttggcctcaaagttgaggttcttgaatgtttgctaattttatgtgcatgatccttgcccaaatatttgtcatccgtccacatagattcacgtgtgcatacaacatgtacaagtaatatttgggctgcccataagaactggaagattcatagggaatgcatatacccttctcagtatggttaggattctgtttttgcttcatttaattccagagttcctcagcctcagcaggttctgcttttacctgtcacagaaatgtccagtgtttaatgcatttggttgctggggcttacatgccagcctcctctgatatgtacttggtttttaaaaacccattttgttctctcttgtttcctctctatttccctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaatgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttg

SEQ ID NO: 458238 - DNA, 793 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtat

SEQ ID NO: 458239 - DNA, 746 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatggctgattcaccccaagagtggccgttcctaccacgaggagttcaaccctccaaaagagcccatgaaagatgaccgtatgtaaactcaggacaaaaaatttccttttctttccttcccctttcttcactgtttttctttttcctttattctttccatcttccttttatttctaccaatattactaacttagtcatgaaaaataacactatcaagtaaatcacatggcctgtgtcagatctattcagtgtctcctcaggtggtttattgcttggcctcaaggttgcttccagtggtgctagctttttgcagtgcccagattgtacctgtcttctgtcaagagcagccccttttctggcatcatggccacctaagtgatcagctaatcaggagaagctttcttaaaagcctacaattggagagtgggaagagtgtggcactgaagagaagttt

SEQ ID NO: 458240 - DNA, 1765 bp, Homo sapiens
gagtccgtcgtgctcaggggcgggcggaacgggctgacggacgcggctatgggccagtgtgagcggcgagtgggacgtgcgtggcgtgcgtgcgttgacctgggaagcactggacctgtgaggcgtgcgaactggtggcagtgagagacttcggcggacatggctcccagcgtgccagcggcagaacccgagtatcctaaaggcatccgggccgtgctgctggggcctcccggggccggtaaagggacccaggcacccagattggctgaaaacttctgtgtctgccatttagctactggggacatgctgagggccatggtggcttctggctcagagctaggaaaaaagctgaaggcaactatggatgctgggaaactggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttg

SEQ ID NO: 458241 - DNA, 3510 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgaga

SEQ ID NO: 458242 - DNA, 3396 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaatgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgaga

SEQ ID NO: 458243 - DNA, 3182 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttccctgagctttttaaataccctgtgaaaattttctttcctcccttggtcatcatgcatctaattgtggggaaatgtttgtcaaaccaacctgcaaagcagcatggtgtagttgagaagaataaacagagaagactgggtgagctattgtttgtttgcttctttgggcctgggtttcctcatctaatctgcaaaccaagaatgcagactagtcctaccactcccggaagactgacgttgtgccaggtattatgcaaaggcttcatgtaaccctcgacttcacgtaaccctcacacagcaccctgtggagtcagaactgtccttcacttttataggtgaggaaaccagactcagagaggtgaagtggcattcctgaggtcatgcataagaggcagtcaggactgaaacacagtctctaacacttatccgtccccttgatcttgttgctgaagtgatttaattacttgcgtagctctgcacacaggaagggctgctctgaataagagctcttttccatggacactcagcgctgccggaactgattttgaagaagtcactgccggctctgagggcctagggtatgtgtcttaggatctcctgtgtgcacaaagtgtcactgacagaacacagcaggatggagagcagcctcctcagaagcctcacaagtctttcctcagatgaagacagagcaacgagtcagaagacagatttcaacagcgacttcaccatgcgaccttggacaagttatctcacctcatcagtagaataggaatgatccctacccctcaaaggtgctgatgacactagtgaccaagatactcatgtgggttggactgcccaggacacagcagatgcttagtaaacacagatggaattcagagggaaaatgtaggcattgaagaaagttgtcttactgaccatccggaaccaggctaaggatcccctagaaatcatagacctctgaaattatatgcagaattctttatgtgttttcataattaataatagtctaacatattaaattcttagctgtgtgaga

SEQ ID NO: 458244 - DNA, 2286 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtccccgtacatcgttagaagcttgaattcgagcagtagtagtagtagtagtaggcggccgc

SEQ ID NO: 458245 - DNA, 824 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtat

SEQ ID NO: 458246 - DNA, 1788 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatcctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatttgaaagagatgtaaggtgtattcatagggatggtggctcaacaaatcaagcaaactggaatcaaggggagggggaagggaatgaaatggaaagggaggctgattcccttcccctgacttaccactaatttactaggctacctactttcatgagtaacctctcacagctacccagcacatgccacaatcctatgctcttgccttcttttatctgcactgtgtgaagggactcttttaaataaatgagcaagtgtcctaagctatgtcatccaaagattgtcctttccattctcaaatcctgtgactgggatcactcaacagcactgtgatgtattattttcaatgaggtgcctttcttaactgaccaaatgctgccttgtttggcccctaaatcaataaaatatgttaaaatttgaaaaaaaaaaaaaagaaaaaaaacaaaaaaaaaaaaaagaaaaaaaaaataaaaacaaaaaggcacaagacaacgcaacaaaggaacaaagaagatgacagaccaagaaaagaacaaacagaaagacacagaacgagcacacaactcagagaaacagaacacaagcggcagagcgcagctgacatatcaacatgcgagaggagaaggagagagcag

SEQ ID NO: 458247 - DNA, 3738 bp, Homo sapiens
  misc_feature (27)..(27): n is a, c, g, or t
  misc_feature (47)..(47): n is a, c, g, or t
  misc_feature (86)..(86): n is a, c, g, or t
  misc_feature (163)..(164): n is a, c, g, or t
taaaccgggtgtctttagtcctaaagntcttgactttggcacattcnccagttgagcagcagcctctatgttccacgttcagtaanaattccagtccttcatatcttttgtagctcaccctcaagctctcccgcttcaccatccaatagtttctcccatcacnnccagcaccactagtggtgttggtgagtgatgaaatggtagtggagctcattgagaagaatttggagacccccttgtgcaaaaatggttttcttctggatggcttccctcggactgtgaggcaggcagaaatgctcgatgacctcatggagaagaggaaagagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgatccgtcgatcagatgataatgaaaaggccttgaaaatccgcctgcaagcctaccacactcaaaccaccccactcatagagtactacaggaaacgggggatccactccgccatcgatgcatcccagacccccgatgtcgtgttcgcaagcatcctagcagccttctccaaagccacatgtaaagacttggttatgtttatctaatgttgggtccaagaaggaatttctttccatccctgtgaggcaatgggtgggaatgataggacaggcaaagagaagcttcctcaggctagcaaaaatatcatttgatgtattgattaaaaaagcacttgcttgatgtatctttggcgtgtgtgctactctcatctgtgtgtatgtgtgttgtgtgtgtgtgtgtgtgcatgcacatatgtgttcactctgctactttgtaagttttaggctaggttgctttaccagctgtttacttcttttttgttgttgttttgagacaaggtttcgctctgccaccctggctggagtgcagtggcgtgatcttggctcacggcaacctctgcctcctggggctcaagcaattatcccacctcagcctcctgagcagctgggactacaggtgcatgccacaacacctggctgatatttgtattttttgtagagacaggattttgccaagttgcccaggctggtcttgaactcctaggcttaagcaatccacccaccttggcctcctgaagtgccaggatcacagacgtgagccactacacccagcccagctgtttacttctttaaccatacttttgattttattttttgaccaaaatgaactaacccaggtaatcttccagggaccgcaattccagaacctcatagtatttcttccatttccagcagctgattagaagtccaggatcatgtgaagtcaggcagggtcacagttcctgatggcacattatggacagagaattccattttgttttctaacccatgatgaaaacccacgtgagtcagtgtgtgaacagggatcattaattttttccccctaggtggaaggaaaaaggcacttactttgcaggttacagaaattactgggagaggatatcgtcataaaaagagccaggccaaattggaatatttttgtgatctgcatcatgatgctgaaaatagcaattatttgggaattgggtttgaaaactgaattgttgccagagaattaaaccaggtgaaaggtccttttgaattcagattgtcttctgaacatccaggctgatcatctgagagcagtcaaatctacttccccaaaaagagaccagggtaggtttatttgcttttatttttaatgtttgcctgtgtttccaagtgtgaacaaaacagtgtgtgatctattcttggattcattttgatcagtatttattcaaacccagtctctctccaggacataaaactgaaatcagatatgttctttttaagcccaaaccctctcctttctagatccaaccttcacccctaattttatgatggctatagccatggacttccccaagaaaagatcacccagaaataagaccacctgtgacagttaccagcttttattcataaccttagcttcccaactattgagcattttctaaggtccctgctgtcttttggtctctggtttgatttgtggcaaacagatgaagtaacagactgctatgaaggaccacaaaaacggcagcctctggaaaaaccattagaaagtcagtggcagatccagtaaataatatcgccagcctcagcataatctgctgctgactcgattcagtggactctaaagtgcccagcctcctgacctgagctctcctgccatctgtgagactaccagaggtcttatctgctgtccacatggcaactgggcatgagtacctggccaccttgcttccctctttgcctggtccaagtgagtgtctgctgcctctgtcctgccttgttttcctggctctaaaccaactccacccactcttaatggaaactcagtctggctttgtgtgtttctgggaagcacatgacttctgggaatgggcaaggaagaggagtgaaacaaaaactgtcagctatgtgtgcctggtctgggatccttctctgggtgacagtggcatcatgaatcttagaatcagctcccctttaactagggacaattgtaagcacttggcctcaaagttgaggttcttgaatgtttgctaattttatgtgcatgatccttgcccaaatatttgtcatccgtccacatagattcacgtgtgcatacaacatgtacaagtaatatttgggctgcccataagaactggaagattcatagggaatgcatatacccttctcagtatggttaggattctgtttttgcttcatttaattccagagttcctcagcctcagcaggttctgcttttacctgtcacagaaatgtccagtgtttaatgcatttggttgctggggcttacatgccagcctcctctgatatgtacttggtttttaaaaacccattttgttctctcttgtttcctctctatttccctagtatcagaaggccaggcgagactgcaacactgctcatcaccccgcggcgtgatccctgctcttaggtgctgggcagaggggaagggtggtcagggtgaggatggtgagggagggctggtgaggggctcagaggaatacttggaacaacagcagtgttattgtagtgtggcagtttcttttatacataggtgagagtttttaaagtgtaagggaaaaattaattttttaaaaaacaccatgcttggagggtgggggtagaaatagacacaatattatttctaaggaatcgggttttcatttactctggactggtgaaaatattttttaaagccagtgctctaagacctcagcttttatctcagaaccccatgggttccagaccaagagtacaggaaatcaaattgttgtcctgtctgtctatagcttggaacagggagctttgattactgactccggttccacacactgtaagatcaaaaaaccatctccacatctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctgcaaagcagcatggtgtagttgagaagaataaacagagaagactggg

SEQ ID NO: 458248 - DNA, 401 bp, Homo sapiens
cacattttaatttacttttatctgtttttagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgtaagtcaggatgcttttaattttaacagattttaacagcgtgtaaattaaaaacccaaagacagg

SEQ ID NO: 458249 - DNA, 3815 bp, Homo sapiens
aataaacaatggctaccccatagacagagcagtttgcaaatattatgattgataattttaggtctttaagcctttatcatatttgagaacatttatgtaaattatctttaatatttaatcactatgttttaatcatacagctctcacgatatccagaaagcatgttaacagcaactatacctgagtgcattcagttcttaagagatgtgtctgaaatatataatactctatttttctttctgttaagcagtgccttttattttattttattttttaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaagtaagtaagtaaacttgtaaggtaacttgaaacaaacagaacgctgtcttcttttaaaatacaaattaaaatgcaaaattaaagatcagccataaatcatatacttacaggaaaatgtccatagtaatataaaccaaaaaaagctgataattgatatttccggttaattttggggcccagtgttaccaatctagctcccaaagctatccaaagctcaaagttggaaaataccaagggatctaacatgattagctataattatttagaggcttgcattttagatttaggggtgacatcttttttgtacaggaaatattccccgctactgttacaagtgtgtgggatacattgattcatttaatctgcatgttggcggtgtgaatagtagaaaactcacagttgaaaatgcctcttgtcagccacggagcgcacaggcatttgtgtgcgtaaccccgggtagcgttcatgtgcacctaaagtgtgacgacagcctatgggaaaccaagggaagggtcacctgtagaggtccggacattcggttttgcctttaagacaactattagatcctaagcgactgtgttgtggctgagttaaaaatgtgcctgtttacttgcagagcttcttccattaggtgaacaatctgttgtgattttaatgtgtaagacctttggtaatgtgaggaattgattagatagtgcagcccagtctctagaggatcagatctgtgggattggttggggtggttgggcaaagtccatggtgagttaagaaatgactttggaagtgactctaatgtgtacacaaacaacacacatgcacacaccacacatacatacacacacgaacacatacctccatgctgcatatacacacacaggcatacacacactctaatgtgtacacaaacacacatgcacataccacacatacacacacacacatgaacacatacctccatgccacacagacacacacaggcatacacatactctaatgtgtacacaacacacatgcacacaccacacacgaactcacacatccatgccacatatacacacacgggcatacacacatgcaggcacatacactacacacacacacacacacacacacaggcacagttgcatataaacacacaaatgtacacacccccacaccacatatgcacatacacatatacacaccacacatattcatagtcacatacacaaacacacatgtgtatacaattattaatatagtcttaaagtcattctgttggttaagaaaatatttcctgaacacctgtttgctgaattttaaagactgtccatttaatttgcttagaccttagataacaagttaggctaaaagtactatatccatcaactctgaaagttctgtatgtttatgtatggggaccagttaaccaatgtatttatttttgatgttttagatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacgtggccccagcttctccgtgagctctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgtaagtcaggatgcttttaattttaacagattttaacagcgtgtaaattaaaaacccaaagacagg

SEQ ID NO: 458250 - DNA, 3035 bp, Homo sapiens
ggacagcacatgtctgtaggccgtgccgatgatgctgagaagcagcgtgcatgaaataaaataaaaacagacaaggctattcattggagaaaataggaagctgtgctcccttgtgcacaaataccagtcgtcaggagaagtattctgttgtatgagcagcgatttgtgagggcctgggattgtacattttagagataactgggctaaagctctgttgagagcagtgtcctaatgcggcttcatggccagctgcactgtgtttttgcgtcttttgtaatgtgtttattttgtcagtgacattcctctcatagtgtttctagatgaatgtttgttttaacaaaaaactttgggatgtgtggccatgtaccagaattttttcttattttgcatagtgttagtgtatttgtattttgctttaattgtttattttcatttctttccttttctgaagtcaacagctctttataccacctttgatcaagtaagtaagtaaacttgtaaggtaacttgaaacaaacagaacgctgtcttcttttaaaatacaaattaaaatgcaaaattaaagatcagccataaatcatatacttacaggaaaatgtccatagtaatataaaccaaaaaaagctgataattgatatttccggttaattttggggcccagtgttaccaatctagctcccaaagctatccaaagctcaaagttggaaaataccaagggatctaacatgattagctataattatttagaggcttgcattttagatttaggggtgacatcttttttgtacaggaaatattccccgctactgttacaagtgtgtgggatacattgattcatttaatctgcatgttggcggtgtgaatagtagaaaactcacagttgaaaatgcctcttgtcagccacggagcgcacaggcatttgtgtgcgtaaccccgggtagcgttcatgtgcacctaaagtgtgacgacagcctatgggaaaccaagggaagggtcacctgtagaggtccggacattcggttttgcctttaagacaactattagatcctaagcgactgtgttgtggctgagttaaaaatgtgcctgtttacttgcagagcttcttccattaggtgaacaatctgttgtgattttaatgtgtaagacctttggtaatgtgaggaattgattagatagtgcagcccagtctctagaggatcagatctgtgggattggttggggtggttgggcaaagtccatggtgagttaagaaatgactttggaagtgactctaatgtgtacacaaacaacacacatgcacacaccacacatacatacacacacgaacacatacctccatgctgcatatacacacacaggcatacacacactctaatgtgtacacaaacacacatgcacataccacacatacacacacacacatgaacacatacctccatgccacacagacacacacaggcatacacatactctaatgtgtacacaacacacatgcacacaccacacacgaactcacacatccatgccacatatacacacacgggcatacacacatgcaggcacatacactacacacacacacacacacacacacaggcacagttgcatataaacacacaaatgtacacacccccacaccacatatgcacatacacatatacacaccacacatattcatagtcacatacacaaacacacatgtgtatacaattattaatatagtcttaaagtcattctgttggttaagaaaatatttcctgaacacctgtttgctgaattttaaagactgtccatttaatttgcttagaccttagataacaagttaggctaaaagtactatatccatcaactctgaaagttctgtatgtttatgtatggggaccagttaaccaatgtatttatttttgatgttttagatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacgtggccccagcttctccgtgagctctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgtaagtcaggatgcttttaattttaacagattttaacagcgtgtaaattaaaaacccaaagacagg

SEQ ID NO: 458251 - DNA, 2001 bp, Homo sapiens
attcacgcgcgccgcagcggggcaccggaagttatggaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaaatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacaccaaccagcgatacgccgctagccctggctcccagaaagccgcagccttgcaggtgcagaaggagagtgaggcccagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgtaagtcaggatgcttttaattttaacagattttaacagcgtgtaaattaaaaacccaaagacagg

SEQ ID NO: 458252 - DNA, 1138 bp, Homo sapiens
tcatctccagttttgtgcacagagggtgggtgtggcatttgtgatctattattgttaatggcctccatttaaaatcattttattggctgtcatttgcctgccatgtcaagcctattttaatgaagcacttgcttttctagctgcatagaattatttgaagaaagataatgagaaatggggactctaagtggcctacagttcaatagaagaaagctaaaagcccacccaaacatgatagtaaccactgttttctctgcactaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacgtggccccagcttctccgtgagctctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgtaagtcaggatgcttttaattttaacagattttaacagcgtgtaaattaaaaacccaaagacagg

SEQ ID NO: 458253 - DNA, 1050 bp, Homo sapiens
attcacgcgcgccgcagcggggcaccggaagttatggaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttggtaacgggctgcgactagtatgttgagtcctgtaagtaggagagtgatatttgatcaggagacgtagttactagcacagagagtttcccagcatacac

SEQ ID NO: 458254 - DNA, 262 bp, Homo sapiens
tgaagtgaagacatttaattcattgtttcattttataatggaatggataaagaaattaattttttttttacaggtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaact

SEQ ID NO: 458255 - DNA, 559 bp, Homo sapiens
tccccagcagagtcccacccagggcttcagaggacttgatggatgcactctttccttctattcagcaacaccaggcacgtctctctgctgcggatactaacaaaatattttctctgtttaatttctgaaaggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggtaatttatagggaagaaaatcattaattagattaactcattcagctatgaaaatatagtttatttttcaaatgtaattaactgttaatcatcttttaatatatctgagttacagtatcctccatcagaaaaaaaagtgaatggattacatgtatgtttatattctctatcacagatcaatcaatattaatctcagctaaaataatttaactcgtttcttaaaaacacatttgcttttgtatgtaacagcagct

SEQ ID NO: 458256 - DNA, 2142 bp, Homo sapiens
attcacgcgcgccgcagcggggcaccggaagttatggaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaaatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacgtggccccagcttctccgtgagctctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgtaagtcaggatgcttttaattttaacagattttaacagcgtgtaaattaaaaacccaaagacagg

SEQ ID NO: 458257 - DNA, 3577 bp, Homo sapiens
attcacgcgcgccgcagcggggcaccggaagttatggaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaagtaagtaagtaaacttgtaaggtaacttgaaacaaacagaacgctgtcttcttttaaaatacaaattaaaatgcaaaattaaagatcagccataaatcatatacttacaggaaaatgtccatagtaatataaaccaaaaaaagctgataattgatatttccggttaattttggggcccagtgttaccaatctagctcccaaagctatccaaagctcaaagttggaaaataccaagggatctaacatgattagctataattatttagaggcttgcattttagatttaggggtgacatcttttttgtacaggaaatattccccgctactgttacaagtgtgtgggatacattgattcatttaatctgcatgttggcggtgtgaatagtagaaaactcacagttgaaaatgcctcttgtcagccacggagcgcacaggcatttgtgtgcgtaaccccgggtagcgttcatgtgcacctaaagtgtgacgacagcctatgggaaaccaagggaagggtcacctgtagaggtccggacattcggttttgcctttaagacaactattagatcctaagcgactgtgttgtggctgagttaaaaatgtgcctgtttacttgcagagcttcttccattaggtgaacaatctgttgtgattttaatgtgtaagacctttggtaatgtgaggaattgattagatagtgcagcccagtctctagaggatcagatctgtgggattggttggggtggttgggcaaagtccatggtgagttaagaaatgactttggaagtgactctaatgtgtacacaaacaacacacatgcacacaccacacatacatacacacacgaacacatacctccatgctgcatatacacacacaggcatacacacactctaatgtgtacacaaacacacatgcacataccacacatacacacacacacatgaacacatacctccatgccacacagacacacacaggcatacacatactctaatgtgtacacaacacacatgcacacaccacacacgaactcacacatccatgccacatatacacacacgggcatacacacatgcaggcacatacactacacacacacacacacacacacacaggcacagttgcatataaacacacaaatgtacacacccccacaccacatatgcacatacacatatacacaccacacatattcatagtcacatacacaaacacacatgtgtatacaattattaatatagtcttaaagtcattctgttggttaagaaaatatttcctgaacacctgtttgctgaattttaaagactgtccatttaatttgcttagaccttagataacaagttaggctaaaagtactatatccatcaactctgaaagttctgtatgtttatgtatggggaccagttaaccaatgtatttatttttgatgttttagatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacgtggccccagcttctccgtgagctctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgtaagtcaggatgcttttaattttaacagattttaacagcgtgtaaattaaaaacccaaagacagg

SEQ ID NO: 458258 - DNA, 3523 bp, Homo sapiens
attcacgcgcgccgcagcggggcaccggaagttatggaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaagtaagtaagtaaacttgtaaggtaacttgaaacaaacagaacgctgtcttcttttaaaatacaaattaaaatgcaaaattaaagatcagccataaatcatatacttacaggaaaatgtccatagtaatataaaccaaaaaaagctgataattgatatttccggttaattttggggcccagtgttaccaatctagctcccaaagctatccaaagctcaaagttggaaaataccaagggatctaacatgattagctataattatttagaggcttgcattttagatttaggggtgacatcttttttgtacaggaaatattccccgctactgttacaagtgtgtgggatacattgattcatttaatctgcatgttggcggtgtgaatagtagaaaactcacagttgaaaatgcctcttgtcagccacggagcgcacaggcatttgtgtgcgtaaccccgggtagcgttcatgtgcacctaaagtgtgacgacagcctatgggaaaccaagggaagggtcacctgtagaggtccggacattcggttttgcctttaagacaactattagatcctaagcgactgtgttgtggctgagttaaaaatgtgcctgtttacttgcagagcttcttccattaggtgaacaatctgttgtgattttaatgtgtaagacctttggtaatgtgaggaattgattagatagtgcagcccagtctctagaggatcagatctgtgggattggttggggtggttgggcaaagtccatggtgagttaagaaatgactttggaagtgactctaatgtgtacacaaacaacacacatgcacacaccacacatacatacacacacgaacacatacctccatgctgcatatacacacacaggcatacacacactctaatgtgtacacaaacacacatgcacataccacacatacacacacacacatgaacacatacctccatgccacacagacacacacaggcatacacatactctaatgtgtacacaacacacatgcacacaccacacacgaactcacacatccatgccacatatacacacacgggcatacacacatgcaggcacatacactacacacacacacacacacacacacaggcacagttgcatataaacacacaaatgtacacacccccacaccacatatgcacatacacatatacacaccacacatattcatagtcacatacacaaacacacatgtgtatacaattattaatatagtcttaaagtcattctgttggttaagaaaatatttcctgaacacctgtttgctgaattttaaagactgtccatttaatttgcttagaccttagataacaagttaggctaaaagtactatatccatcaactctgaaagttctgtatgtttatgtatggggaccagttaaccaatgtatttatttttgatgttttagatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacagacttggatcgtcttcctactgagacgtggccccagcttctccgtgagctctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgatcttgcagtacacggagaacctggtggcttacaccagttacgaaaagaacaagtggaatgaaactatcaatcttacacatacagctttgttgaaaatgtggacttttagtgagaagaaacaaatgttaatacatttagccaagaaatccacaagtaaagtactcttatgaaaacttgtaagtcaggatgcttttaattttaacagattttaacagcgtgtaaattaaaaacccaaagacagg

SEQ ID NO: 458259 - DNA, 3436 bp, Homo sapiens
attcacgcgcgccgcagcggggcaccggaagttatggaggtattaataggggaccctattaccacatgtctttctccctcagtgtatgatataatttgtaatcttgggtttcaactcagagaaaattgtgatatcaatagcattgtaactcagaatggtgaagtatgctggaaaacaatcacagactgtgtgagctacacagagtcagagcagggtctggattactggggaagcgtgaggctgctgggccctgtgtgtgaggctgtccattcacatttcttatctctgaccaaggggcaatttgaaattcgatatgcaccgtggttccagtggacaagttttccagagttatttcctgaaatatttgatgccttggaaagtctacaatctcctgctatttctcttagcttaatgaaactgacatcgtgtctagaacgagccttgggtgatgtatttttactgattgggaaggaatgcccctttcttttaagagatctgctttcatctgaggagcttgctcaagtcttcagtcagtctgtgatgaatgtgctaaaagtcttcgttggctctccgtgtggtctcaacctgcgtaacgtcttatggcatgggtttgcgtcacctgaagaaattcctccaaaatactgttcaatgatgatactgttgacggcaggattgggtcagttactgaagagttaccttcaaaacactaaacttacattggcacatcgctctttcatatctcttacaaacctcgaggatttgattgtttttcctgatgttacttatgaggtgctttcagtattagaagaagtgatgatgaaatctgcttttatattaaaaatcatgttaccatattgggaagttgcactggtcaagttcaagtcacacaggtttgctgactgcgccatattgttgctgacacaactggagactggacttaggaatgtttttgccacacttaacagatgtccaaaaagactcctgactgctgagtcaacagctctttataccacctttgatcaagtaagtaagtaaacttgtaaggtaacttgaaacaaacagaacgctgtcttcttttaaaatacaaattaaaatgcaaaattaaagatcagccataaatcatatacttacaggaaaatgtccatagtaatataaaccaaaaaaagctgataattgatatttccggttaattttggggcccagtgttaccaatctagctcccaaagctatccaaagctcaaagttggaaaataccaagggatctaacatgattagctataattatttagaggcttgcattttagatttaggggtgacatcttttttgtacaggaaatattccccgctactgttacaagtgtgtgggatacattgattcatttaatctgcatgttggcggtgtgaatagtagaaaactcacagttgaaaatgcctcttgtcagccacggagcgcacaggcatttgtgtgcgtaaccccgggtagcgttcatgtgcacctaaagtgtgacgacagcctatgggaaaccaagggaagggtcacctgtagaggtccggacattcggttttgcctttaagacaactattagatcctaagcgactgtgttgtggctgagttaaaaatgtgcctgtttacttgcagagcttcttccattaggtgaacaatctgttgtgattttaatgtgtaagacctttggtaatgtgaggaattgattagatagtgcagcccagtctctagaggatcagatctgtgggattggttggggtggttgggcaaagtccatggtgagttaagaaatgactttggaagtgactctaatgtgtacacaaacaacacacatgcacacaccacacatacatacacacacgaacacatacctccatgctgcatatacacacacaggcatacacacactctaatgtgtacacaaacacacatgcacataccacacatacacacacacacatgaacacatacctccatgccacacagacacacacaggcatacacatactctaatgtgtacacaacacacatgcacacaccacacacgaactcacacatccatgccacatatacacacacgggcatacacacatgcaggcacatacactacacacacacacacacacacacacaggcacagttgcatataaacacacaaatgtacacacccccacaccacatatgcacatacacatatacacaccacacatattcatagtcacatacacaaacacacatgtgtatacaattattaatatagtcttaaagtcattctgttggttaagaaaatatttcctgaacacctgtttgctgaattttaaagactgtccatttaatttgcttagaccttagataacaagttaggctaaaagtactatatccatcaactctgaaagttctgtatgtttatgtatggggaccagttaaccaatgtatttatttttgatgttttagatattggcaaaacacttgaatgatggtaaaatcaatcagcttcctcttttccttggagagcctgctatggaatttctctgggatttcctgaaccatcaggagggtccccgcataagagatcatttaagccacggggagatcaacttacatgaattttcaaaagaaacaactaatcagttgcttgcattttctcttgtactgctactcagattcgttgatgactgtctgctatcagtttttaaggaaaaatcagccgtagaattgttgattagtcttgcagaaggctatagttctcgctgtcatccggtttttcagcttaaaaaacaggtgctgagctgtgaggagagcatcagggtttgggctctgctgcctttccccgaagaactcactcggcaagccgtcagattagaagataattctgaaacaaatgcctgccactctttgattacaaaaatgacggatgagctgtatcaccatatgcctgagaatcgttgtgtgttaaaggacttggatcgtcttcctactgagacgtggccccagcttctccgtgagctctgcagcacacctgttcccaccctgttctgccccaggattgtgctggaagtgctggttgtgctccgaagcatcagcgaacagtgccgccgtgtgtccagccaggtcaccgttgcctcagagctgagacacaggcagtgggtggaaaggacgctgcggtctcgccagcggcagaactacctgcgtatgtggagtagtatcagactactgtcccctgtgctcagcctgatactgttactcattgcgctggagttggtcaacattcatgctgtttgtgggaagaatgcgcatgagtatcagcagtacctaaagtttgtaaagtcgattctttgcagtacgcccgttttacgggcgtctgcataggtttggtcctggcctttctattagctcggagtaagattacacatgcaagcatcccacgttgct

SEQ ID NO: 458260 - DNA, 496 bp, Homo sapiens
agtactactgtgattgtcaattatgccttattatttattacattgtttctgtaggaaagtgaattctgcatttaaatttcagggaaccagtcagaagcatctggattaggcatttagtgatacaaggatccagaataacaaaaactatgtaccagccacattcacacaacaggtgatacccctataggttaattattctctagatattctaaattaagagacacagaatacttagtcttatgtgagtcaagagctctattctgtcttcactactgggtgtctactgttataaactggagaatatgtgtggttaaatgccatgtttttcatttttaattgatctttttcttattgctgtggttctttgcctttttaggatttcttgtaaaaacctcaaaatggttataaagagtatcacagatgtggtgttatggttagtgtgtactttgaaagtaatgaatgtttttatgtaattaaatatctttctgccaaaatt

SEQ ID NO: 458261 - DNA, 523 bp, Homo sapiens
agctgcagttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttgggtaagtattttttaaaggtttatgttgagtggtgagaaaatactaacagaaaaagatgggaaaatttttttgaggctaataattcaggaatttcagtaatttgtggctaattaagtttaggtttgaggcagttttcaaacaacagtgagttacatttgaaa

SEQ ID NO: 458262 - DNA, 2643 bp, Homo sapiens
tgcagtgagccgaccatcgtgccactgcactccagcctgggcgacagagcgagactccgtctcaaaaaaaaaaaaaaaaaaaaaaaaaaaaatcccaccacaccacctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggtggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatcttcccagtgccatgcggtctcatgggtgtgtttgtgtgtataatgtctaattgaatctgcagaaatgaccaagcaatcacttttttggagtatagttttataaaaaaagaatgcagggtttgaagttccttacctgataattgtgtctggcacatgataggggatcagtaaattgtaattcctaaccctactgtactcccaaacatggtgattcatggtcaagaaaaatcttatatatatgtatgtatacatatatgtgtatatatacgtatgtatgtatacatatatgtgtatatatacgtgtgtatgtatacatatatgtgtatatatacgtgtgtatgtatacatatatgtgtataatatatgtgtgtatatatatacacatatatacgtatatatgtatatatatatacacagttgaatcagtgggattaatacctataatctctggttttcaaaggtaatatggaatatttgacacttggtaaaaggtgaactacctttgtagtgaatcttttcctcttggtagcatcaacactggggataaatcagaaccattctgtggaatgaaatgtttctcaagagcctataatatagtagatagtgcatattaagatgtctggctgggcatggtggctcatgcctgtaatcccagcactttgggaggctgaggcgggaggatcacttgagcctagaagttggagactaacctggcgagaccctgtctcaaaaaaaaaaaaaaatcaatttagctagcaggaatttgacatttaaagagggaatcttctctacctctacaaaatcaacacttaacacttttttcaccttcagaattatttagaatgtggatttactttgtctagttttttcctttatagtgtaatttattgttactctctatttactgactaccagagatatacaaaatactgtgcaaaagattgttactgttcaaagagcttacaaactaaatttaaaagaatagcaagtctgaaaaatagaagatagtcaaatatttgtttatgctaagaactgtttttaattttcagctttgatgtaaattgctagcttaggtgtctttagttcaagcatgttaggaaatcctctttattcttaaatatagatacatgtctgcatatatgattgaattttagagccagaaagcatgtagagcagttgtgattagtagaaaatacactgacaagaagatatttgcatttatttcccaaagctgccagtaactagattttgtgacttaagtcatttaacctctccttgattagagcttcctgagccatgcacactggcactgcaaatcacagacaggcctagatacagatcccctcaccccttgctacatccaaaggtggcctgggtggctggagcctctgggccagaaccacctttgtccattttcctcagtgtgcctacagcatcgctttccatgtgtgccataacttgggaatagttgggatgtgttgcttaactcctttgcaccattagttatctgtgagaccatctattccacactcttcattttttaaaaagagacaataattatttttaactcactgaagtttaaaactacctagcatttctgattaaaaaaaatttagaaggaaaattttaatgcatttatttcagatggcgttttaaatagatacaaccctttggaaacacaatatggtactacatagcaagggctgtaaaaatgaccatatcctttgccccataaattctacttctatacttttaaccttaaaaataattcagaaaaaagataaatgcatgaagacatttatgtctgcattctttataataacaaaaattggggaaaaaaactccatgtcaagaaagtgggataagaaaaatagtgaagtattatactgccattaaaataattatttggaagactgtagaaacgtggacatgtttgatatggtaagtaaaatgagcacaatacaaaatagtatgcatactatgattgtgactttgtaaaatctttatgcatgtggaaggtaatctgcaaaacaaattcattgtgttagtgtagcgggatatggaatgactttatttatttaaatcttttctttaatattactttgtattttcaataaaaataaatcactgtacatagtaaga

SEQ ID NO: 458263 - DNA, 3008 bp, Homo sapiens
agctgcagttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttggggaaccagtcagaagcatctggattaggcatttagtgatacaaggatccagaataacaaaaactatgtaccagccacattcacacaacaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggtggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatcttcccagtgccatgcggtctcatgggtgtgtttgtgtgtataatgtctaattgaatctgcagaaatgaccaagcaatcacttttttggagtatagttttataaaaaaagaatgcagggtttgaagttccttacctgataattgtgtctggcacatgataggggatcagtaaattgtaattcctaaccctactgtactcccaaacatggtgattcatggtcaagaaaaatcttatatatatgtatgtatacatatatgtgtatatatacgtatgtatgtatacatatatgtgtatatatacgtgtgtatgtatacatatatgtgtatatatacgtgtgtatgtatacatatatgtgtataatatatgtgtgtatatatatacacatatatacgtatatatgtatatatatatacacagttgaatcagtgggattaatacctataatctctggttttcaaaggtaatatggaatatttgacacttggtaaaaggtgaactacctttgtagtgaatcttttcctcttggtagcatcaacactggggataaatcagaaccattctgtggaatgaaatgtttctcaagagcctataatatagtagatagtgcatattaagatgtctggctgggcatggtggctcatgcctgtaatcccagcactttgggaggctgaggcgggaggatcacttgagcctagaagttggagactaacctggcgagaccctgtctcaaaaaaaaaaaaaaatcaatttagctagcaggaatttgacatttaaagagggaatcttctctacctctacaaaatcaacacttaacacttttttcaccttcagaattatttagaatgtggatttactttgtctagttttttcctttatagtgtaatttattgttactctctatttactgactaccagagatatacaaaatactgtgcaaaagattgttactgttcaaagagcttacaaactaaatttaaaagaatagcaagtctgaaaaatagaagatagtcaaatatttgtttatgctaagaactgtttttaattttcagctttgatgtaaattgctagcttaggtgtctttagttcaagcatgttaggaaatcctctttattcttaaatatagatacatgtctgcatatatgattgaattttagagccagaaagcatgtagagcagttgtgattagtagaaaatacactgacaagaagatatttgcatttatttcccaaagctgccagtaactagattttgtgacttaagtcatttaacctctccttgattagagcttcctgagccatgcacactggcactgcaaatcacagacaggcctagatacagatcccctcaccccttgctacatccaaaggtggcctgggtggctggagcctctgggccagaaccacctttgtccattttcctcagtgtgcctacagcatcgctttccatgtgtgccataacttgggaatagttgggatgtgttgcttaactcctttgcaccattagttatctgtgagaccatctattccacactcttcattttttaaaaagagacaataattatttttaactcactgaagtttaaaactacctagcatttctgattaaaaaaaatttagaaggaaaattttaatgcatttatttcagatggcgttttaaatagatacaaccctttggaaacacaatatggtactacatagcaagggctgtaaaaatgaccatatcctttgccccataaattctacttctatacttttaaccttaaaaataattcagaaaaaagataaatgcatgaagacatttatgtctgcattctttataataacaaaaattggggaaaaaaactccatgtcaagaaagtgggataagaaaaatagtgaagtattatactgccattaaaataattatttggaagactgtagaaacgtggacatgtttgatatggtaagtaaaatgagcacaatacaaaatagtatgcatactatgattgtgactttgtaaaatctttatgcatgtggaaggtaatctgcaaaacaaattcattgtgttagtgtagcgggatatggaatgactttatttatttaaatcttttctttaatattactttgtattttcaataaaaataaatcactgtacatagtaaga

SEQ ID NO: 458264 - DNA, 3127 bp, Homo sapiens
agctgcagttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggtcagtgagaagcccgtgggcccccgccctgcctgctactcccatccccacctgcgcgctccccatgggggacgacccccgattgggtccgatgcctaccctcggggtggagccggcaggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttggggaaccagtcagaagcatctggattaggcatttagtgatacaaggatccagaataacaaaaactatgtaccagccacattcacacaacaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggtggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatcttcccagtgccatgcggtctcatgggtgtgtttgtgtgtataatgtctaattgaatctgcagaaatgaccaagcaatcacttttttggagtatagttttataaaaaaagaatgcagggtttgaagttccttacctgataattgtgtctggcacatgataggggatcagtaaattgtaattcctaaccctactgtactcccaaacatggtgattcatggtcaagaaaaatcttatatatatgtatgtatacatatatgtgtatatatacgtatgtatgtatacatatatgtgtatatatacgtgtgtatgtatacatatatgtgtatatatacgtgtgtatgtatacatatatgtgtataatatatgtgtgtatatatatacacatatatacgtatatatgtatatatatatacacagttgaatcagtgggattaatacctataatctctggttttcaaaggtaatatggaatatttgacacttggtaaaaggtgaactacctttgtagtgaatcttttcctcttggtagcatcaacactggggataaatcagaaccattctgtggaatgaaatgtttctcaagagcctataatatagtagatagtgcatattaagatgtctggctgggcatggtggctcatgcctgtaatcccagcactttgggaggctgaggcgggaggatcacttgagcctagaagttggagactaacctggcgagaccctgtctcaaaaaaaaaaaaaaatcaatttagctagcaggaatttgacatttaaagagggaatcttctctacctctacaaaatcaacacttaacacttttttcaccttcagaattatttagaatgtggatttactttgtctagttttttcctttatagtgtaatttattgttactctctatttactgactaccagagatatacaaaatactgtgcaaaagattgttactgttcaaagagcttacaaactaaatttaaaagaatagcaagtctgaaaaatagaagatagtcaaatatttgtttatgctaagaactgtttttaattttcagctttgatgtaaattgctagcttaggtgtctttagttcaagcatgttaggaaatcctctttattcttaaatatagatacatgtctgcatatatgattgaattttagagccagaaagcatgtagagcagttgtgattagtagaaaatacactgacaagaagatatttgcatttatttcccaaagctgccagtaactagattttgtgacttaagtcatttaacctctccttgattagagcttcctgagccatgcacactggcactgcaaatcacagacaggcctagatacagatcccctcaccccttgctacatccaaaggtggcctgggtggctggagcctctgggccagaaccacctttgtccattttcctcagtgtgcctacagcatcgctttccatgtgtgccataacttgggaatagttgggatgtgttgcttaactcctttgcaccattagttatctgtgagaccatctattccacactcttcattttttaaaaagagacaataattatttttaactcactgaagtttaaaactacctagcatttctgattaaaaaaaatttagaaggaaaattttaatgcatttatttcagatggcgttttaaatagatacaaccctttggaaacacaatatggtactacatagcaagggctgtaaaaatgaccatatcctttgccccataaattctacttctatacttttaaccttaaaaataattcagaaaaaagataaatgcatgaagacatttatgtctgcattctttataataacaaaaattggggaaaaaaactccatgtcaagaaagtgggataagaaaaatagtgaagtattatactgccattaaaataattatttggaagactgtagaaacgtggacatgtttgatatggtaagtaaaatgagcacaatacaaaatagtatgcatactatgattgtgactttgtaaaatctttatgcatgtggaaggtaatctgcaaaacaaattcattgtgttagtgtagcgggatatggaatgactttatttatttaaatcttttctttaatattactttgtattttcaataaaaataaatcactgtacatagtaaga

SEQ ID NO: 458265 - DNA, 1131 bp, Homo sapiens
agctgcagttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttggggtaatccaaatctatttctggaaccatgaaaattttgctagtttttgactttgacaatacaatcatagatgacaatagtgacacttggattgtacaatgtgctcccaacaaaaagcttcctattgaactacgtgattcttatcgaaaaggattttggacagaatttatgggcagagtctttaagtatttgggagataagggtgtaagagaacatgaaatgaaaagagcagtgacatcattgcctttcactccagggatggtggaactcttcaactttataagaaagaataaggataaatttgactgcattattatttcagattcaaattcggtcttcatagattgggttttagaagctgccagttttcatgacatatttgataaagtgtttacaaatccagcagcttttaatagcaatggtcatctcactgttgaaaattatcatactcattcttgcaatagatgcccaaagaatctttgcaaaaaggtagttttgatagaatttgtagataaacagttacaacagggagtgaattatacacaaattgtttatattggtgatggtggaaatgatgtctgtccagtcacctttttaaagaatgatgatgttgccatgccacggaaaggatataccttacagaaaactctttccagaatgtctcaaaatcttgagcctatggaatattctgttgtagtttggtcctcaggtgttgatataatttctcatttacaatttctaataaaggattaatatgtcagcaaaaaaaa

SEQ ID NO: 458266 - DNA, 1642 bp, Homo sapiens
gagctgcttgtggggtggagcggcactagctggcggcttccgagcgcctcttccaaagatggtcagaggggccggaggcgtccccgctcccgctcgctactagcccgcgggccagcgccgcgtcccgagccccggcgggagccatggctctaaaaggacaagaagattatatttatcttttcaaggattcaacacatccagtggattttctggatgcattcagaacattttacttggatggattatttactgatattactcttcagtgtccttcaggcataattttccattgtcaccgagccgttttagctgcttgcagcaattattttaaggcaatgttcacagctgacatgaaagaaaaatttaaaaataaaataaaactctctggcatccaccatgatattctggaaggccttgtaaattatgcatacacttcccaaattgaaataactaaaagaaatgttcaaagcctgcttgaggcagcggatctgctacagttcctttcagtaaagaaggcttgtgagcggttttggtaaggcacttggatattgataattgtattggaatgcactcctttgcagaatttcatgtgtgtccagaactagagaaggaatctcgaagaattctatgttcaaagtttaaggaaagtgtggcaacaagaagaatttctggaaatcagccttgaaaagttctctttatcttgtccagaaagaatctcagtgtttggaaagaagaagctatcatagagccagttattaagtggactgctcatgatgtagaaaatcgaattgaatgcctctataatctactgagctatatcaacattgatatagatccagtgtacttaaaaacagccttaggccttcaaagaagctgcctgctcaccgaaaataagatccgctccctaatatacaatgccttgaatcccatgcataaagagatttcccagaggtccacagccacaatgtatataattggaggctattactggcatcctttatcagaggttcacatatgggatcctttgacaaatgtttggattcagggagcagaaataccagattataccagggagagctatggtgttacatgtttaggacccaacatttatgtaactgggggctacaggacggataacatagaagctcttgacacagtgtggatctataacagtgaaagtgatgaatggacagaaggtttgccaatgctcaatgccaggtattaccactgtgcagtcaccttgggtggctgtgtctatgctttaggtggttacagaaaaggggctccagcagaagaggctgagttctatgatcctttaaaagagaaatggattcctattgcaaacatgattaaaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccaggatacatgaagaagatggccatctgcaaaccaggaagcaggtcatcatgagacaccagatctaacagcatcttgatcttggacttctcagccttcaaaactgcgagcaataaatttctgttgtttaagacaaaa

SEQ ID NO: 458267 - DNA, 691 bp, Homo sapiens
agctgcagttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggtcagtgagaagcccgtgggcccccgccctgcctgctactcccatccccacctgcgcgctccccatgggggacgacccccgattgggtccgatgcctaccctcggggtggagccggcaggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttggggaaccagtcagaagcatctggattaggcatttagtgatacaaggatccagaataacaaaaactatgtaccagccacattcacacaacaggatttcttgtaaaaacctcaaaatggttataaagagtatcacagatgtggtgttatggttagtgtgtactttgaaagtaatgaatgtttttatgtaattaaatatctttctgccaaaatt

SEQ ID NO: 458268 - DNA, 714 bp, Homo sapiens
ggctcactgcaacctctgcctcccgggttcaagcagttctcctgcctcagcctcctgagtagctgggattacaggcatgtgccaccacacctaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagacggagtctcgctctcgcccaggctggagtgcagtggcgcgatctcgggtcactgcaagctccgcctcccaggttcacgccattctcctgcctcagcctcccgagtagctgggactacaggcgcccactaccatgcctggctagtttttttgtatttttagtagagactgggtttcaccgtgttagccaggatgatctgaatctcctgacctcgtgatccgcccgcctcggcctcccaaagtgctgggattacaggcgtgagccaccgcgcccggcctttctaaaacttttcaagtgtgcatttttattcaccaactttattttgtgtcttcactacgtagtttacttattgtaagcatgtacttattgtaagcatgtacttattttgtctcttcgctacgtagtttacttattgtaagcatgagcttttaatattaatattatatgtggcttagagtggaataatg

SEQ ID NO: 458269 - DNA, 3911 bp, Homo sapiens
gagctgcttgtggggtggagcggcactagctggcggcttccgagcgcctcttccaaagatggtcagaggggccggaggcgtccccgctcccgctcgctactagcccgcgggccagcgccgcgtcccgagccccggcgggagccatggctctaaaaggacaagaagattatatttatcttttcaaggattcaacacatccagtggattttctggatgcattcagaacattttacttggatggattatttactgatattactcttcagtgtccttcaggcataattttccattgtcaccgagccgttttagctgcttgcagcaattattttaaggcaatgttcacagctgacatgaaagaaaaatttaaaaataaaataaaactctctggcatccaccatgatattctggaaggccttgtaaattatgcatacacttcccaaattgaaataactaaaagaaatgttcaaagcctgcttgaggcagcggatctgctacagttcctttcagtaaagaaggcttgtgagcggttttggtaaggcacttggatattgataattgtattggaatgcactcctttgcagaatttcatgtgtgtccagaactagagaaggaatctcgaagaattctatgttcaaagtttaaggaaagtgtggcaacaagaagaatttctggaaatcagccttgaaaagttctctttatcttgtccagaaagaatctcagtgtttggaaagaagaagctatcatagagccagttattaagtggactgctcatgatgtagaaaatcgaattgaatgcctctataatctactgagctatatcaacattgatatagatccagtgtacttaaaaacagccttaggccttcaaagaagctgcctgctcaccgaaaataagatccgctccctaatatacaatgccttgaatcccatgcataaagagatttcccagaggtccacagccacaatgtatataattggaggctattactggcatcctttatcagaggttcacatatgggatcctttgacaaatgtttggattcagggagcagaaataccagattataccagggagagctatggtgttacatgtttaggacccaacatttatgtaactgggggctacaggacggataacatagaagctcttgacacagtgtggatctataacagtgaaagtgatgaatggacagaaggtttgccaatgctcaatgccaggtattaccactgtgcagtcaccttgggtggctgtgtctatgctttaggtggttacagaaaaggggctccagcagaagaggctgagttctatgatcctttaaaagagaaatggattcctattgcaaacatgattaaaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggtggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatcttcccagtgccatgcggtctcatgggtgtgtttgtgtgtataatgtctaattgaatctgcagaaatgaccaagcaatcacttttttggagtatagttttataaaaaaagaatgcagggtttgaagttccttacctgataattgtgtctggcacatgataggggatcagtaaattgtaattcctaaccctactgtactcccaaacatggtgattcatggtcaagaaaaatcttatatatatgtatgtatacatatatgtgtatatatacgtatgtatgtatacatatatgtgtatatatacgtgtgtatgtatacatatatgtgtatatatacgtgtgtatgtatacatatatgtgtataatatatgtgtgtatatatatacacatatatacgtatatatgtatatatatatacacagttgaatcagtgggattaatacctataatctctggttttcaaaggtaatatggaatatttgacacttggtaaaaggtgaactacctttgtagtgaatcttttcctcttggtagcatcaacactggggataaatcagaaccattctgtggaatgaaatgtttctcaagagcctataatatagtagatagtgcatattaagatgtctggctgggcatggtggctcatgcctgtaatcccagcactttgggaggctgaggcgggaggatcacttgagcctagaagttggagactaacctggcgagaccctgtctcaaaaaaaaaaaaaaatcaatttagctagcaggaatttgacatttaaagagggaatcttctctacctctacaaaatcaacacttaacacttttttcaccttcagaattatttagaatgtggatttactttgtctagttttttcctttatagtgtaatttattgttactctctatttactgactaccagagatatacaaaatactgtgcaaaagattgttactgttcaaagagcttacaaactaaatttaaaagaatagcaagtctgaaaaatagaagatagtcaaatatttgtttatgctaagaactgtttttaattttcagctttgatgtaaattgctagcttaggtgtctttagttcaagcatgttaggaaatcctctttattcttaaatatagatacatgtctgcatatatgattgaattttagagccagaaagcatgtagagcagttgtgattagtagaaaatacactgacaagaagatatttgcatttatttcccaaagctgccagtaactagattttgtgacttaagtcatttaacctctccttgattagagcttcctgagccatgcacactggcactgcaaatcacagacaggcctagatacagatcccctcaccccttgctacatccaaaggtggcctgggtggctggagcctctgggccagaaccacctttgtccattttcctcagtgtgcctacagcatcgctttccatgtgtgccataacttgggaatagttgggatgtgttgcttaactcctttgcaccattagttatctgtgagaccatctattccacactcttcattttttaaaaagagacaataattatttttaactcactgaagtttaaaactacctagcatttctgattaaaaaaaatttagaaggaaaattttaatgcatttatttcagatggcgttttaaatagatacaaccctttggaaacacaatatggtactacatagcaagggctgtaaaaatgaccatatcctttgccccataaattctacttctatacttttaaccttaaaaataattcagaaaaaagataaatgcatgaagacatttatgtctgcattctttataataacaaaaattggggaaaaaaactccatgtcaagaaagtgggataagaaaaatagtgaagtattatactgccattaaaataattatttggaagactgtagaaacgtggacatgtttgatatggtaagtaaaatgagcacaatacaaaatagtatgcatactatgattgtgactttgtaaaatctttatgcatgtggaaggtaatctgcaaaacaaattcattgtgttagtgtagcgggatatggaatgactttatttatttaaatcttttctttaatattactttgtattttcaataaaaataaatcactgtacatagtaaga

SEQ ID NO: 458270 - DNA, 3858 bp, Homo sapiens
gagctgcttgtggggtggagcggcactagctggcggcttccgagcgcctcttccaaagatggtcagaggggccggaggcgtccccgctcccgctcgctactagcccgcgggccagcgccgcgtcccgagccccggcgggagccatggctctaaaaggacaagaagattatatttatcttttcaaggattcaacacatccagtggattttctggatgcattcagaacattttacttggatggattatttactgatattactcttcagtgtccttcaggcataattttccattgtcaccgagccgttttagctgcttgcagcaattattttaaggcaatgttcacagctgacatgaaagaaaaatttaaaaataaaataaaactctctggcatccaccatgatattctggaaggccttgtaaattatgcatacacttcccaaattgaaataactaaaagaaatgttcaaagcctgcttgaggcagcggatctgctacagttcctttcagtaaagaaggcttgtgagcggttttggtaaggcacttggatattgataattgtattggaatgcactcctttgcagaatttcatgtgtgtccagaactagagaaggaatctcgaagaattctatgttcaaagtttaaggaaagtgtggcaacaagaagaatttctggaaatcagccttgaaaagttctctttatcttgtccagaaagaatctcagtgtttggaaagaagaagctatcatagagccagttattaagtggactgctcatgatgtagaaaatcgaattgaatgcctctataatctactgagctatatcaacattgatatagatccagtgtacttaaaaacagccttaggccttcaaagaagctgcctgctcaccgaaaataagatccgctccctaatatacaatgccttgaatcccatgcataaagagatttcccagaggtccacagccacaatgtatataattggaggctattactggcatcctttatcagaggttcacatatgggatcctttgacaaatgtttggattcagggagcagaaataccagattataccagggagagctatggtgttacatgtttaggacccaacatttatgtaactgggggctacaggacggataacatagaagctcttgacacagtgtggatctataacagtgaaagtgatgaatggacagaaggtttgccaatgctcaatgccaggtattaccactgtgcagtcaccttgggtggctgtgtctatgctttaggtggttacagaaaaggggctccagcagaagaggctgagttctatgatcctttaaaagagaaatggattcctattgcaaacatgattaaaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggtggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatcttcccagtgccatgcggtctcatgggtgtgtttgtgtgtataatgtctaattgaatctgcagaaatgaccaagcaatcacttttttggagtatagttttataaaaaaagaatgcagggtttgaagttccttacctgataattgtgtctggcacatgataggggatcagtaaattgtaattcctaaccctactgtactcccaaacatggtgattcatggtcaagaaaaatcttatatatatgtatgtatacatatatgtgtatatatacgtatgtatgtatacatatatgtgtatatatacgtgtgtatgtatacatatatgtgtatatatacgtgtgtatgtatacatatatgtgtataatatatgtgtgtatatatatacacatatatacgtatatatgtatatatatatacacagttgaatcagtgggattaatacctataatctctggttttcaaaggtaatatggaatatttgacacttggtaaaaggtgaactacctttgtagtgaatcttttcctcttggtagcatcaacactggggataaatcagaaccattctgtggaatgaaatgtttctcaagagcctataatatagtagatagtgcatattaagatgtctggctgggcatggtggctcatgcctgtaatcccagcactttgggaggctgaggcgggaggatcacttgagcctagaagttggagactaacctggcgagaccctgtctcaaaaaaaaaaaaaaatcaatttagctagcaggaatttgacatttaaagagggaatcttctctacctctacaaaatcaacacttaacacttttttcaccttcagaattatttagaatgtggatttactttgtctagttttttcctttatagtgtaatttattgttactctctatttactgactaccagagatatacaaaatactgtgcaaaagattgttactgttcaaagagcttacaaactaaatttaaaagaatagcaagtctgaaaaatagaagatagtcaaatatttgtttatgctaagaactgtttttaattttcagctttgatgtaaattgctagcttaggtgtctttagttcaagcatgttaggaaatcctctttattcttaaatatagatacatgtctgcatatatgattgaattttagagccagaaagcatgtagagcagttgtgattagtagtagattttgtgacttaagtcatttaacctctccttgattagagcttcctgagccatgcacactggcactgcaaatcacagacaggcctagatacagatcccctcaccccttgctacatccaaaggtggcctgggtggctggagcctctgggccagaaccacctttgtccattttcctcagtgtgcctacagcatcgctttccatgtgtgccataacttgggaatagttgggatgtgttgcttaactcctttgcaccattagttatctgtgagaccatctattccacactcttcattttttaaaaagagacaataattatttttaactcactgaagtttaaaactacctagcatttctgattaaaaaaaatttagaaggaaaattttaatgcatttatttcagatggcgttttaaatagatacaaccctttggaaacacaatatggtactacatagcaagggctgtaaaaatgaccatatcctttgccccataaattctacttctatacttttaaccttaaaaataattcagaaaaaagataaatgcatgaagacatttatgtctgcattctttataataacaaaaattggggaaaaaaactccatgtcaagaaagtgggataagaaaaatagtgaagtattatactgccattaaaataattatttggaagactgtagaaacgtggacatgtttgatatggtaagtaaaatgagcacaatacaaaatagtatgcatactatgattgtgactttgtaaaatctttatgcatgtggaaggtaatctgcaaaacaaattcattgtgttagtgtagcgggatatggaatgactttatttatttaaatcttttctttaatattactttgtattttcaataaaaataaatcactgtacatagtaaga

SEQ ID NO: 458271 - DNA, 1250 bp, Homo sapiens
agctgcagttggcggtcgggctagagaagagaggcgcctgcgcttgcgagctgggcttgtgagtggggctgccgagagggcaggcgtggggcgaggccaaaggactgaacccgcaggagcgtcacgggcgccggggcggctgccgacggcgggactgggtcagtgagaagcccgtgggcccccgccctgcctgctactcccatccccacctgcgcgctccccatgggggacgacccccgattgggtccgatgcctaccctcggggtggagccggcaggttttctatcagatgttccacgtaataatgctggagttaagaagtttccattattttgctccaaaccagaagactctgttccctgtatatagaataggagtaatatttgaaaacaactggctgatgtttaaaactgaagattgtcatgattgtttatcctaatcccaatgctgaagtaagattgtcttggaaatactaagttggggtaatccaaatctatttctggaaccatgaaaattttgctagtttttgactttgacaatacaatcatagatgacaatagtgacacttggattgtacaatgtgctcccaacaaaaagcttcctattgaactacgtgattcttatcgaaaaggattttggacagaatttatgggcagagtctttaagtatttgggagataagggtgtaagagaacatgaaatgaaaagagcagtgacatcattgcctttcactccagggatggtggaactcttcaactttataagaaagaataaggataaatttgactgcattattatttcagattcaaattcggtcttcatagattgggttttagaagctgccagttttcatgacatatttgataaagtgtttacaaatccagcagcttttaatagcaatggtcatctcactgttgaaaattatcatactcattcttgcaatagatgcccaaagaatctttgcaaaaaggtagttttgatagaatttgtagataaacagttacaacagggagtgaattatacacaaattgtttatattggtgatggtggaaatgatgtctgtccagtcacctttttaaagaatgatgatgttgccatgccacggaaaggatataccttacagaaaactctttccagaatgtctcaaaatcttgagcctatggaatattctgttgtagtttggtcctcaggtgttgatataatttctcatttacaatttctaataaaggattaatatgtcagcaaaaaaaa

SEQ ID NO: 458272 - DNA, 642 bp, Homo sapiens
aggcgtgagccacggcgccctgccggcatgaagttttgaacttgccattttgccgctctagtgctgcctaaggcactttgaaggcagtaattgcagaggcatttcgtgccttcaaagctcagtcccaacctaagttccttaccctctgagatgatcccaggagtggcctcctctgttgcatgacatttagatccagggctctctgaagcctatggacttagtaccattcatgtgagatggagtgatggcaggaaaagaattctgtgttgcaactgctgtgccctgaagttgagacctcagttgaaggtaatgataaaaaaagaaatgctaggtgcattattactgcttcatctctacttccttgggttagttaaaaggcatttaccagattagttaacactgaaaacaggatctgtcacgagccaagtatttcagtgtgtgttttgtgttttgctcaaaataaccctggtatccaacactcacattaaacaccacaggaagattttggttgaatgtgtactgaaggttgaggggtgcctgcaacgcaatctcatggacttacctttttttctgtactgactagaaactgattgcactatagccaaattacataccagcacaaagggaattcagcggcaggcc

SEQ ID NO: 458273 - DNA, 449 bp, Homo sapiens
aaatgaagtttcgctcttgttgcccaggctggagtgcaatggcatgatctcggctcaccgcaacctctgcctcctgggttgaagcaattctcctgcttcagcctctcgagtagctgggattacaggcatgtgccaccatgcctggctaattttgtatttttagtagggacggggtttctccatgttggtcaggctggtcccgaactcctgacctcaggtggtccgcccgcctcggcctcccaaagtgctgggattacaggcgtgagccacggcgccctgccggcatgaagttttgaacttgccattttgccgctctagtgctgcctaaggcactttgaaggcagtaattgcagaggcatttcgtgccttcaaagctcagtcccaacctaagttccttaccctctgagatgatcccaggagtggcctcctctgttgcatgacatttagat

SEQ ID NO: 458274 - DNA, 306 bp, Homo sapiens
aggcgtgagccacggcgccctgccggcatgaagttttgaacttgccattttgccgctctagtgctgcctaaggcactttgaaggcagtaattgcagaggcatttcgtgccttcaaagctcagtcccaacctaagttccttaccctctgagatgatcccaggagtggcctcctctgttgcatgacatttagatccagggctctctgaagcctatggacttagtaccattcatgtgagatggagtgatggcaggaaaagaattctgtgttgcaactgctgtgccctgaagttgagacctcagttgaag

SEQ ID NO: 458275 - DNA, 455 bp, Homo sapiens
accgttgcggtaacaacgccccgccccgtcgggcgggcgggctgcgcgaggctggctggcggcgggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccagctgtgctgagatctgttttacataccgtaaagctcacccatttgaagtgtatggttcagtgggtcttagtatactatcttcacagaacattttcatcactccgaaaagaagaagaaaccctgaacctgccatgaacagccacttgcccttcctcctcccagccccgggcaactgtgaatccactttctgtctctgtggatttgcctgttttgaacctttcatataaacagaatcacacact

SEQ ID NO: 458276 - DNA, 3993 bp, Homo sapiens
accgttgcggtaacaacgccccgccccgtcgggcgggcgggctgcgcgaggctggctggcggcgggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccagacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacgctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcaggaggacacgcagtacatggccatgcggcagcagcccatgcaccagaagcccaggtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaccttgacacaggccatccgtaactttgccaagagcttggaaggctggttgacaaatgccatgagtgacttcccacaacaggtcatccagaccaaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagagttcaacgatctcgcctctctgtcgctgacgctgctcgacaaagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctccttggagacactgaagctcacagttaacggattgtaatgcccggcttttcctcactcctggtaaccaatacaagctggtttctgccttaaac

SEQ ID NO: 458277 - DNA, 3463 bp, Homo sapiens
accgttgcggtaacaacgccccgccccgtcgggcgggcgggctgcgcgaggctggctggcggcgggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccagctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcaggaggacacgcagtacatggccatgcggcagcagcccatgcaccagaagcccaggtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaccttgacacaggccatccgtaactttgccaagagcttggaaggctggttgacaaatgccatgagtgacttcccacaacaggtcatccagaccaaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagagttcaacgatctcgcctctctgtcgctgacgctgctcgacaaagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctccttggagacactgaagctcacagttaacggattgtaatgcccggcttttcctcactcctggtaaccaatacaagctggtttctgccttaaac

SEQ ID NO: 458278 - DNA, 2143 bp, Homo sapiens
accgttgcggtaacaacgccccgccccgtcgggcgggcgggctgcgcgaggctggctggcggcgggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccagacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctccttggagacactgaagctcacagttaacggattgtaatgcccggcttttcctcactcctggtaaccaatacaagctggtttctgccttaaac

SEQ ID NO: 458279 - DNA, 467 bp, Homo sapiens
gagaccctgtcgcaaaaaaacaaacaaacaaacaaaaaaaaaaaacagaaaccagggacagtcctgtgagccaaggctgggcctctgtccacaactctagtttccactgcactggaggagcgttgtcattctcctggtcccgcccccacgtatacagaggagccagggcgcacagacacgctagcagagctctggggatcagtcgcagctccctgaactgtgtgggcccgtttggaatatgtcgtctgtacattactgtctcctcagtgtctttctaggcgtgccgactgtgggcgggaacattgtcatttggtactaaatgttcataaaggcaatagaagacacgtctagcttgaataatctgcaggcaactcacgagggcgtgactggcggtaacgcagcgtatccgatgtttcaggtgcagccggtgcagcacgtgtatcctgcccaggtgcagtacgtggaag

SEQ ID NO: 458280 - DNA, 243 bp, Homo sapiens
cggccgccgccgccaccgccgccgccatagagactgtagccgtggagactgttacttaccaacggggaccaacacgcagcagccgctgccgccgccgcgggagccgctgcccgaactcccggcccgaactccaggtgaccgatgcgaccgccccgggcccagcccggccggggagtgtggggggcggcggggaccccgttcgggggccggggggcgggcagcacgtccccgccgctcacccca

SEQ ID NO: 458281 - DNA, 4068 bp, Homo sapiens
accgttgcggtaacaacgccccgccccgtcgggcgggcgggctgcgcgaggctggctggcggcgggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccagacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacgcttgaaatggcgattgaaaacctccaaaaaagcgaaggaatcacatcacacaaaagcggtttactcaacagccatctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcaggaggacacgcagtacatggccatgcggcagcagcccatgcaccagaagcccaggtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaccttgacacaggccatccgtaactttgccaagagcttggaaggctggttgacaaatgccatgagtgacttcccacaacaggtcatccagaccaaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagagttcaacgatctcgcctctctgtcgctgacgctgctcgacaaagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctccttggagacactgaagctcacagttaacggattgtaatgcccggcttttcctcactcctggtaaccaatacaagctggtttctgccttaaac

SEQ ID NO: 458282 - DNA, 3895 bp, Homo sapiens
accgttgcggtaacaacgccccgccccgtcgggcgggcgggctgcgcgaggctggctggcggcgggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacgctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcaggaggacacgcagtacatggccatgcggcagcagcccatgcaccagaagcccaggtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaccttgacacaggccatccgtaactttgccaagagcttggaaggctggttgacaaatgccatgagtgacttcccacaacaggtcatccagaccaaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagagttcaacgatctcgcctctctgtcgctgacgctgctcgacaaagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctccttggagacactgaagctcacagttaacggattgtaatgcccggcttttcctcactcctggtaaccaatacaagctggtttctgccttaaac

SEQ ID NO: 458283 - DNA, 2919 bp, Homo sapiens
agccccgagccccccaacaagcatcctctctgaagcagcagcccctccgcatccatgtccatcgcctgctcctctcctctctgtggcctcccttgggattccagggcaccccgctgtagcccggatcacggctgctcacttgacgtgtgctgagtgcacgtgatgggcgcacgcacccgtctgtctcaccggtcccttcattcctaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaccttgacacaggccatccgtaactttgccaagagcttggaaggctggttgacaaatgccatgagtgacttcccacaacaggtcatccagaccaaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagagttcaacgatctcgcctctctgtcgctgacgctgctcgacaaagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctccttggagacactgaagctcacagttaacggattgtaatgcccggcttttcctcactcctggtaaccaatacaagctggtttctgccttaaac

SEQ ID NO: 458284 - DNA, 2282 bp, Homo sapiens
  misc_feature (1664)..(1664): n is a, c, g, or t
  misc_feature (1804)..(1804): n is a, c, g, or t
  misc_feature (2019)..(2019): n is a, c, g, or t
ggcacgaggagagagggagcgtggagagctggagcagccgccaccgccgccgccgagggagccccgggacggcagcccctgggcgcagggtgcgctgttctcggagtccgacccagggcgactcacgcccactggtgcgacccggacagcctgggactgacccgccggcccaggcgaggctgcagccagagggctgggaagggatcgcgctcgcggcatccagaggcggccaggcggaggcgagggagcaggttagagggacaaagagctttgcagacgtccccggcgtcctgcgagcgccagcggccgggacgaggcggccgggagcccgggaagagcccgtggatgttctgcgcgcggcctgggagccgccgccgccgccgcctcagcgagaggaggaatgcaccggccgcgccgccgcgggacgcgcccgccgctcctggcgctgctggccgcgctgctgctggccgcacgcggggctgctgcccaagaaacagagctgtcagtcagtgctgaattagtgcctacctcatcatggaacatctcaagtgaactcaacaaagattcttacctgacccttgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggcccccctcccactgcaagtccaggatactcagatgagtatgaagaagatggattctgtcagccatacagagggattgcatgtgcaagatttattggcaaccgcaccgtctatatggagtctttgcacatgcaaggggaaatagaaaatcagatcacagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaaatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgcttcaccttggatgaaaactttaagtctgatctgtgtgacatcccagcttgcggtaaatagaagtcattgcccctaatgtattcaatcatctttaaagatccctatcctacccctcttatttaggagaatcctataagggggncaaagaaaatggacagtatttgcttgatctcaatctggttttagggtaaaccttgccgtttctacataaaacacctcgtaaggtaccaaaacacgttctcaagaagtcaactgcctttatacctgcagccattgcactcntggatgtaacagggacccagcccttcagaggcacagttgagacagtttatcacattgatttttatagaaaaagatgttacccagaatggtctgcgtccaagtggaccttttcagcaaaaaaaggaatattggaagcaggaagaaattgttttctgtatgccttaagaacaccacaaggcaggatgaatctacaaccattactcggtcatccaggncaatctgtgggtaaactgtgtccttcgttatgtctgttaatactgcagaagaagcatataggtatctagtaagaaaatggaattcctgagtcagttaactgttcctttttctagaaaatgtttggagaaaataatgaaaatgggccaagcatggtggcttatacctgtaatcccaacactctaggaaggccgaggcaggaggatcatttgagcccaggggttcaagaccagcccaggcaacatagtgagactccatctctacc

SEQ ID NO: 458285 - DNA, 1215 bp, Homo sapiens
gcaccgcaagccggagcgtcttagttcgctgcgggaagctggggtccttgctgcgtctgagccggtacacaatgagagggaagagcccggctgagcctgtggagacaaccgattcattctttggagaaacagagctgtcagtcagtgctgaattagtgcctacctcatcatggaacatctcaagtgaactcaacaaagattcttacctgacccttgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggcccccctcccactgcaagtccaggatactcagatgagtatgaagaagatggattctgtcagccatacagagggattgcatgtgcaagatttattggcaaccgcaccgtctatatggagtctttgcacatgcaaggggaaatagaaaatcagatcacagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaaatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgttcctggtgaaattagttgacttgggaaccctggatccagtcccggagatacaggacct

SEQ ID NO: 458286 - DNA, 3444 bp, Homo sapiens
ggcacgaggagagagggagcgtggagagctggagcagccgccaccgccgccgccgagggagccccgggacggcagcccctgggcgcagggtgcgctgttctcggagtccgacccagggcgactcacgcccactggtgcgacccggacagcctgggactgacccgccggcccaggcgaggctgcagccagagggctgggaagggatcgcgctcgcggcatccagaggcggccaggcggaggcgagggagcaggttagagggacaaagagctttgcagacgtccccggcgtcctgcgagcgccagcggccgggacgaggcggccgggagcccgggaagagcccgtggatgttctgcgcgcggcctgggagccgccgccgccgccgcctcagcgagaggaggaatgcaccggccgcgccgccgcgggacgcgcccgccgctcctggcgctgctggccgcgctgctgctggccgcacgcggggctgctgcccaagaaacagagctgtcagtcagtgctgaattagtgcctacctcatcatggaacatctcaagtgaactcaacaaagattcttacctgacccttgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggcccccctcccactgcaagtccaggatactcagatgagtatgaagaagatggattctgtcagccatacagagggattgcatgtgcaagatttattggcaaccgcaccgtctatatggagtctttgcacatgcaaggggaaatagaaaatcagatcacagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaaatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgcttcaccttggatgaaaactttaagtctgatctgtgtgacatcccagcttgcgattcaaaggattccaaggagaagaataaaatggaaatcctgtacatactagtgccaagtgtggccattcccctggccattgctttactcttcttcttcatttgcgtctgtcggaataaccagaagtcatcgtcggcaccagtccagaggcaaccaaaacacgtcagaggtcaaaatgtggagatgtcaatgctgaatgcatataaacccaagagcaaggctaaagagctacctctttctgctgtacgctttatggaagaattgggtgagtgtgcctttggaaaaatctataaaggccatctctatctcccaggcatggaccatgctcagctggttgctatcaagaccttgaaagactataacaacccccagcaatggatggaatttcaacaagaagcctccctaatggcagaactgcaccaccccaatattgtctgccttctaggtgccgtcactcaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccagaaaaaaaaaaaaaaaaaaaaaacaagcaaacaaaaacattgtgggatgtgcactccattgg

SEQ ID NO: 458287 - DNA, 3079 bp, Homo sapiens
gcaccgcaagccggagcgtcttagttcgctgcgggaagctggggtccttgctgcgtctgagccggtacacaatgagagggaagagcccggctgagcctgtggagacaaccgattcattctttggagaaacagagctgtcagtcagtgctgaattagtgcctacctcatcatggaacatctcaagtgaactcaacaaagattcttacctgacccttgatgaaccaatgaataacatcaccacgtctctgggccagacagcagaactgcactgcaaagtctctgggaatccacctcccaccatccgctggttcaaaaatgatgctcctgtggtccaggagccccggaggctctcctttcggtccaccatctatggctctcggctgcggattagaaacctcgacaccacagacacaggctacttccagtgcgtggcaacaaacggcaaggaggtggtttcttccactggagtcttgtttgtcaagtttggcccccctcccactgcaagtccaggatactcagatgagtatgaagaagatggattctgtcagccatacagagggattgcatgtgcaagatttattggcaaccgcaccgtctatatggagtctttgcacatgcaaggggaaatagaaaatcagatcacagctgccttcactatgattggcacttccagtcacttatctgataagtgttctcagttcgccattccttccctgtgccactatgccttcccgtactgcgatgaaacttcatccgtcccaaagccccgtgacttgtgtcgcgatgaatgtgaaatcctggagaatgtcctgtgtcaaacagagtacatttttgcaagatcaaatcccatgattctgatgaggctgaaactgccaaactgtgaagatctcccccagccagagagcccagaagctgcgaactgtatccggattggaattcccatggcagatcctataaataaaaatcacaagtgttataacagcacaggtgtggactaccgggggaccgtcagtgtgaccaaatcagggcgccagtgccagccatggaattcccagtatccccacacacacactttcaccgcccttcgtttcccagagctgaatggaggccattcctactgccgcaacccagggaatcaaaaggaagctccctggtgcttcaccttggatgaaaactttaagtctgatctgtgtgacatcccagcttgcgattcaaaggattccaaggagaagaataaaatggaaatcctgtacatactagtgccaagtgtggccattcccctggccattgctttactcttcttcttcatttgcgtctgtcggaataaccagaagtcatcgtcggcaccagtccagaggcaaccaaaacacgtcagaggtcaaaatgtggagatgtcaatgctgaatgcatataaacccaagagcaaggctaaagagctacctctttctgctgtacgctttatggaagaattgggtgagtgtgcctttggaaaaatctataaaggccatctctatctcccaggcatggaccatgctcagctggttgctatcaagaccttgaaagactataacaacccccagcaatggatggaatttcaacaagaagcctccctaatggcagaactgcaccaccccaatattgtctgccttctaggtgccgtcactcaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccagaaaaaaaaaaaaaaaaaaaaaacaagcaaacaaaaacattgtgggatgtgcactccattgg

SEQ ID NO: 458288 - DNA, 650 bp, Homo sapiens
gcacgagaaatatctttataaagatatttttcttttccctgacaaagccaaaaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaa

SEQ ID NO: 458289 - DNA, 1901 bp, Homo sapiens
gcagaaagaaaaatgttacagattcaagttcagctgagtctttacataatacatgatgttctgttgattatttttatttttttgatgccactattaacagcaaccagtaaacattatttcccctcaagcagactggcttctaaacctaaccacttaagtttcttcttctccctcattacctcacagtcttcattttgaatattaagtttggggatatctgaagtaattgaaattgagggttttaagatctaagtgaaaagctttacttgggtcaaaaggcagatttccaacaaatttcttttcttattccatctagtatctgtacatgttttgaaattaagggtatatacaaatgtgaattatgaggggtttttttctttgttgtgttttttttttttttttttactttttcctttgagacattctaaaatattgttaggtgatctaaataatttattttcttttttccagcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaa

SEQ ID NO: 458290 - DNA, 1598 bp, Homo sapiens
ctcccgcaggggttacgaacgaaaggcgagcgcgtggcgctcaggagcccgcgcacgcgctgtgttctcgtctccgaccatgagcgtccgcgcggccgtcgtagcatcttttcttcagacccgcccggctcgtctacttaacctagcggaggcttggagtgagagcagcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaa

SEQ ID NO: 458291 - DNA, 1640 bp, Homo sapiens
gccactgatctccttttttccctcgctgtattactccgtaaggccacgtttaggggcatgtaaagtcccaaccctccagtctctgaagtccagacgtataagcaacacctcggactctctttaaaccagttttagttcggagttgctttccatgattaacaaggtatgtgggatgagaacagaccagaatgcagagcttattaaagactgcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaa

SEQ ID NO: 458292 - DNA, 1593 bp, Homo sapiens
gccactgatctccttttttccctcgctgtattactccgtaaggccacgtttaggggcatgtaaagtcccaaccctccagtctctgaagtccagacgtataagcaacacctcggactctctttaaaccagttttagttcggagttgctttccatgattaacaagcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaa

SEQ ID NO: 458293 - DNA, 3139 bp, Homo sapiens
ctcccgcaggggttacgaacgaaaggcgagcgcgtggcgctcaggagcccgcgcacgcgctgtgttctcgtctccgaccatgagcgtccgcgcggccgtcgtagcatcttttcttcagacccgcccggctcgtctacttaacctagcggaggcttggagtgagagcagggaagtgtggggcgaggtgggcggggcgttgcacgcgtgcgcggccagcgaaagaagggagggggcgggagatccgagacaacgttaccccgtcaacacccaatcaggagccggcctgaccccgccccctcttctcacgttattggctgagaggcccccagatgggcggggccggccgtggggttggggagggcagggggcggggaggaggaggaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcactggttaaccaagttgtacacattgtaccacattcagcataactttaggaagaaattccactttgtggaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagtaaaaattatgcggtctgttaagaaaaatgagtaatttgtgttttggacttgaaataaacagtgttctgtagataa

SEQ ID NO: 458294 - DNA, 3296 bp, Homo sapiens
ctcccgcaggggttacgaacgaaaggcgagcgcgtggcgctcaggagcccgcgcacgcgctgtgttctcgtctccgaccatgagcgtccgcgcggccgtcgtagcatcttttcttcagacccgcccggctcgtctacttaacctagcggaggcttggagtgagagcagggaagtgtggggcgaggtgggcggggcgttgcacgcgtgcgcggccagcgaaagaagggagggggcgggagatccgagacaacgttaccccgtcaacacccaatcaggagccggcctgaccccgccccctcttctcacgttattggctgagaggcccccagatgggcggggccggccgtggggttggggagggcagggggcggggaggaggaggaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcactggttaaccaagttgtacacattgtaccacattcagcataactttaggaagaaattccactttgtggaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagtaaaaattatgcggtctgttaagaaaaatgagtaatttgtgttttggacttgaaataaacagtgttctgtagataaaaaaaagaaaaaaaacaaaaaagaaaagaaaaaaaaaaaaagaaaaaacgaaaaaagtaaaagaccaagaaaaacgaacctctcaccccgcacactacatgacaatacgagccaccttaaactaacaattgtcacatacaccaacagccacacgcag

SEQ ID NO: 458295 - DNA, 2195 bp, Homo sapiens
ctcccgcaggggttacgaacgaaaggcgagcgcgtggcgctcaggagcccgcgcacgcgctgtgttctcgtctccgaccatgagcgtccgcgcggccgtcgtagcatcttttcttcagacccgcccggctcgtctacttaacctagcggaggcttggagtgagagcagggaagtgtggggcgaggtgggcggggcgttgcacgcgtgcgcggccagcgaaagaagggagggggcgggagatccgagacaacgttaccccgtcaacacccaatcaggagccggcctgaccccgccccctcttctcacgttattggctgagaggcccccagatgggcggggccggccgtggggttggggagggcagggggcggggaggaggaggaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaa

SEQ ID NO: 458296 - DNA, 1898 bp, Homo sapiens
ctcccgcaggggttacgaacgaaaggcgagcgcgtggcgctcaggagcccgcgcacgcgctgtgttctcgtctccgaccatgagcgtccgcgcggccgtcgtagcatcttttcttcagacccgcccggctcgtctacttaacctagcggaggcttggagtgagagcagggaagtgtggggcgaggtgggcggggcgttgcacgcgtgcgcggccagcgaaagaagggagggggcgggagatccgagacaacgttaccccgtcaacacccaatcaggagccggcctgaccccgccccctcttctcacgttattggctgagaggcccccagatgggcggggccggccgtggggttggggagggcagggggcggggaggaggaggaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcaccaccaggatcaccaccagattcttccggtccggctcga

SEQ ID NO: 458297 - DNA, 567 bp, Homo sapiens
cgaagccctgctaagtcagcgcatttttcgcatcaaacaggtcattcgtgacctgtccatactcctcttctactcttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaa

SEQ ID NO: 458298 - DNA, 1783 bp, Homo sapiens
ggggggtgggaggcttgtggatggccaagtgtggctcgttgggagaggggtgcaaaaaggggggacaaagtgggattgaaagagtctaagcctgtgggggcgcatagataaagcgcaggttggtatgggatacagtcggcagttgtttcgcgaagcgcaggaatagtatgggcaccggaaatggctaagcatgtgggtgcggtgagtattgtaagcgcaatgttatgcttgaagtgtaaggtggctgaactgtcgcgtagacgatgtgtccgtcagtagtcgtgcttctggctgtagggtggctcagtggaatccagttttgttaacaccgacaattagttgtttcacagcccagtgtgtaagccagaagggcatgctctcgggtctgcccattcttggagataccagcttcaaattcaccaacaccagcagcaacaatcaggacagcacagtcagcctgagatgtccctgtaatcatgtttttgataaagtctctgtgtcctggggcatcaatgatagtcacaaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcactggttaaccaagttgtacacattgtaccacattcagcataactttaggaagaaattccactttgtggaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagtaaaaattatgcggtctgttaagaaaaatgagtaatttgtgttttggacttgaaataaacagtgttctgtagataa

SEQ ID NO: 458299 - DNA, 1264 bp, Homo sapiens
ctcccgcaggggttacgaacgaaaggcgagcgcgtggcgctcaggagcccgcgcacgcgctgtgttctcgtctccgaccatgagcgtccgcgcggccgtcgtagcatcttttcttcagacccgcccggctcgtctacttaacctagcggaggcttggagtgagagcagggaagtgtggggcgaggtgggcggggcgttgcacgcgtgcgcggccagcgaaagaagggagggggcgggagatccgagacaacgttaccccgtcaacacccaatcaggagccggcctgaccccgccccctcttctcacgttattggctgagaggcccccagatgggcggggccggccgtggggttggggagggcagggggcggggaggaggaggaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccgggtgaggagttggaaggggaggggaaggaccccctgcagctgaagcacaacccccttcggacagggaggcctctgggcaccgggttagtttgcccagccttctcgtctccgggacccccgcgcctcggccgccgcacctgggacggcccatcccgcccctacacacacaccgtccccccgcagctacgggcacctccagttcttcccccgaaaccagggtccccggtggcgccccagagaccagctctcagcattcatctttcttccatcccatttctcctcgcagccttttttttttgtttctttggctggatttttcaaaatcgttttagttgtcacaggtcaacgctggcccttaaccttttttgagtctcctgattcctgggatggatggggcaccagggaagggagatttctgaagttgggacctaaactaaagttttggg

SEQ ID NO: 458300 - DNA, 646 bp, Homo sapiens
gcctcaaaaattgtgatacttacagtcagcttcttcattaaggtttagttttttaaaaatacaggcttatatttaaaactgagttgattactgatttcaatactataatttattccaaaatgattttacagatcttaacactcgaaatgtagataaaaaatatctttcccctttcttatgccctcataacatcagtttttaccacttgtgtgatgctgtcccagctgtttatctgacccctgggtcccttggaacagctgttctggtttagctgggtactgagatgggtcctggacttactcatttttaaaaaagatctccaagtgattctgatgcagtatccaactaagaatcactggtacagaacaccctcttgcaaagaattcccaagccttataagttccctaatcctgttttcttttgttcaggctttacatgtgtataaagaccagccatggtgaagcaattttagaatatttagataatattctaataatcatattttatatgattctaaaacagacaaatgccttttctctgtataatggaatagtgaaacaaatttgatcaccactgattttcttttgatgtatctttcagaaaaatatgattatgtaggcagactcctaaaaccaggagaagaacc

SEQ ID NO: 458301 - DNA, 2249 bp, Homo sapiens
ctcccgcaggggttacgaacgaaaggcgagcgcgtggcgctcaggagcccgcgcacgcgctgtgttctcgtctccgaccatgagcgtccgcgcggccgtcgtagcatcttttcttcagacccgcccggctcgtctacttaacctagcggaggcttggagtgagagcagggaagtgtggggcgaggtgggcggggcgttgcacgcgtgcgcggccagcgaaagaagggagggggcgggagatccgagacaacgttaccccgtcaacacccaatcaggagccggcctgaccccgccccctcttctcacgttattggctgagaggcccccagatgggcggggccggccgtggggttggggagggcagggggcggggaggaggaggaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaa

SEQ ID NO: 458302 - DNA, 3241 bp, Homo sapiens
ctcccgcaggggttacgaacgaaaggcgagcgcgtggcgctcaggagcccgcgcacgcgctgtgttctcgtctccgaccatgagcgtccgcgcggccgtcgtagcatcttttcttcagacccgcccggctcgtctacttaacctagcggaggcttggagtgagagcagggaagtgtggggcgaggtgggcggggcgttgcacgcgtgcgcggccagcgaaagaagggagggggcgggagatccgagacaacgttaccccgtcaacacccaatcaggagccggcctgaccccgccccctcttctcacgttattggctgagaggcccccagatgggcggggccggccgtggggttggggagggcagggggcggggaggaggaggaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcaggtgggtttaagtcagagctagttccccaacagaaagatcatttgaaaccagtttttatcccttctctttccttccctttccctaaatcaaatcaatattaattgtgccttatttcacttaacatagacttgaattatttttagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaataagcttgagttggactttatatacagaactgtaagccagtgcattatgatacagttgtaagattgtgcatttgattcaagataaggaaaaatcttggaaatgaaaagcaggcactggttaaccaagttgtacacattgtaccacattcagcataactttaggaagaaattccactttgtggaacattctccagaaatccaagattattcaggtaagaattggtatattaaatgtacatctttttactttctattttgatgccaactgattatactagacaattagcactccaggtggttattgaacacaaaacagtaaaagaatattgcactgatagatactaaattattattttattaggttgaaaaagcccttactaaaagcccctcatatatcaattactttatttcattatgactacttaggttccgggctggggacaagttcacttaaaaaggcaatgttatttaacaggtcaccagttaagacttctgctttgtagatacatgcagaagccatcaaacaagggggagcttttaactgcaacaataagctaaagtatgtaaaatactacattctattcagtcttggagtgttttgtagaaagttatcttcagccaaatctttgctgaagactggttgtggagtgttggtaaatgctttgtgtttttatgtaaaatattttctaaacaaaaaatgttaaaagtacatgtcctctgtagtaaactgatatctatatatatgaatcattcaagcctaaagtctagtaataaactgtacttgtgaatagagaaaccctaaatattcatgcagtaaaaattatgcggtctgttaagaaaaatgagtaatttgtgttttggacttgaaataaacagtgttctgtagataacaaaaaagaaaaaaaaagggggggggtaaaaaattcccgggggccaattacggacccttttttggaaggggcccagggaggtaaaaaaggagggggtaaagg

SEQ ID NO: 458303 - DNA, 2106 bp, Homo sapiens
ctcccgcaggggttacgaacgaaaggcgagcgcgtggcgctcaggagcccgcgcacgcgctgtgttctcgtctccgaccatgagcgtccgcgcggccgtcgtagcatcttttcttcagacccgcccggctcgtctacttaacctagcggaggcttggagtgagagcagggaagtgtggggcgaggtgggcggggcgttgcacgcgtgcgcggccagcgaaagaagggagggggcgggagatccgagacaacgttaccccgtcaacacccaatcaggagccggcctgaccccgccccctcttctcacgttattggctgagaggcccccagatgggcggggccggccgtggggttggggagggcagggggcggggaggaggaggaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaa

SEQ ID NO: 458304 - DNA, 2290 bp, Homo sapiens
ctcccgcaggggttacgaacgaaaggcgagcgcgtggcgctcaggagcccgcgcacgcgctgtgttctcgtctccgaccatgagcgtccgcgcggccgtcgtagcatcttttcttcagacccgcccggctcgtctacttaacctagcggaggcttggagtgagagcagggaagtgtggggcgaggtgggcggggcgttgcacgcgtgcgcggccagcgaaagaagggagggggcgggagatccgagacaacgttaccccgtcaacacccaatcaggagccggcctgaccccgccccctcttctcacgttattggctgagaggcccccagatgggcggggccggccgtggggttggggagggcagggggcggggaggaggaggaaggcgctggcgggcagtgatggcggctggtgatggggacgtgaagctaggcaccctggggagtggcagcgagagcagcaacgacggcggcagcgagagtccaggcgacgcgggagcggcagcggaagggggaggctgggcggcggcggcgttggcgcttctgacggggggcggggaaatgctgctgaacgtggcgctggtggctctggtgctgctgggggcctaccggctgtgggtgcgctgggggcggcggggtctgggggccggggccggggcgggcgaggagagccccgccacctctctgcctcgcatgaagaagcgggacttcagcttggagcagctgcgccagtacgacggctcccgcaacccgcgcatcctgctcgcggtcaatgggaaagtcttcgacgtgaccaaaggcagcaagttctacggcccggcgggtccatatggaatatttgctggtagggatgcctccagaggactggccacattttgcctagataaagatgcacttagagatgaatatgatgatctctcagatttgaatgcagtacaaatggagagtgttcgagaatgggaaatgcagtttaaagaaaaatatgattatgtaggcagactcctaaaaccaggagaagaaccatcagaatatacagatgaagaagataccaaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttccttttttccttctttcctttcttctttctctttctttctttttaaaatatattgaagacaaccagatatgtatttgctactcaagtgtacagatctcctcaagaaacatcaagggactcctgtgtcacatactgtgtttttattttaacatgggtgagggaggcgacctgatcaggggaggtgggggtacacatcaatttgagttgttcaggctactgaaacattaaaatgtgaattcccaaacttttctttttggctttgtcagggaaaagaaaaatatctttataaagaaatctttggaaattaggagaaggaatttcagggaaagcccctataatgaattcagaaatcactacaagcagcattaagactgaagttggaatattctgttgaccataaaaccttgatatcattctgtgtatatagaatgtaaaaggaatattacagtgttaactgccatatatgtaatatacacaaactcaattagcattgtaatggccaaatgcattcccccatgcttttctgttttcaaaaaaattgaaaaacaaatcaactcttatccccaacagctgcctaattttaggagtctgaccctccacatctcactggtgtgggtgcatggggctgtggagtgggtgtcagtatggatgtgtctgaatgtgtgaggccttggaagggactctttctgcagatactgtaaatacaagtaccattttaataaagcatgtacaataaaccaaaaaacaaaaaaaaaaaaaaaaaaaaaaaaaaaaaagaaaaaaaacaaaaaagaaaagaaaaaaaaaaaaagaaaaaacgaaaaaagtaaaagaccaagaaaaacgaacctctcaccccgcacactacatgacaatacgagccaccttaaactaacaattgtcacatacaccaacagccacacgcag

SEQ ID NO: 458305 - DNA, 1822 bp, Homo sapiens
ctacaaggaggcaggcaagacagcaaggcatagagacaacatagagctaagtaaagccagtggaaatgaagagtcttccaatcctactgttgctgtgcgtggcagtttgctcagcctatccattggatggagctgcaaggggtgaggacaccagcatgaaccttgttcagaaatatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtgatgcgcaagcccaggtgtggagttcctgatgttggtcacttcagaacctttcctggcatcccgaagtggaggaaaacccaccttacatacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagagaacatggagacttttacccttttgatggacctggaaatgttttggcccatgcctatgcccctgggccagggattaatggagatgcccactttgatgatgatgaacaatggacaaaggatacaacagggaccaatttatttctcgttgctgctcatgaaattggccactccctgggtctctttcactcagccaacactgaagctttgatgtacccactctatcactcactcacagacctgactcggttccgcctgtctcaagatgatataaatggcattcagtccctctatggacctccccctgactcccctgagacccccctggtacccacggaacctgtccctccagaacctgggacgccagccaactgtgatcctgctttgtcctttgatgctgtcagcactctgaggggagaaatcctgatctttaaagacaggcacttttggcgcaaatccctcaggaagcttgaacctgaattgcatttgatctcttcattttggccatctcttccttcaggcgtggatgccgcatatgaagttactagcaaggacctcgttttcatttttaaaggaaatcaattctgggccatcagaggaaatgaggtacgagctggatacccaagaggcatccacaccctaggtttccctccaaccgtgaggaaaatcgatgcagccatttctgataaggaaaagaacaaaacatatttctttgtagaggacaaatactggagatttgatgagaagagaaattccatggagccaggctttcccaagcaaatagctgaagactttccagggattgactcaaagattgatgctgtttttgaagaatttgggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgctttaaccccatcggatagcggggggcaagaggtctcaccagacaaagacgcaatcgtgtgcaacaggcaagtgtctccatctgtctagagtagttgggtcaatcatcaggaaaacttccctcctacca

SEQ ID NO: 458306 - DNA, 538 bp, Homo sapiens
ttccagggattgactcaaagattgatgctgtttttgaagaatttggtaagaggatacttactgtgttggccatagagcacttgaaacattttatgatatcagagggaagaggagcattgaaactttttaataacaagtgtttcttagggccagttccctcctcaaaattttgattcgcctacatttgtactcattatagaactacttcacaaaataacttgtttggaaccataaagataattacacaaatctcgctactttatcttatacatgcatataaaatcaaagtgctccagtgtcacttacatctcgagctaacatgtggagtcaagctcgactttcagattaccatgttagcataaaaatcccatcaagtggtgtggccaggtttaatgttggttagctggccttctcctccaccctatcttattgctgctactaattcccagggagattttttgtctgtctttcctgagttgtcagtcattgcccatgccagtcatttgcaaatacttacctttccatgtgcccaaagttt

SEQ ID NO: 458307 - DNA, 1819 bp, Homo sapiens
ctacaaggaggcaggcaagacagcaaggcatagagacaacatagagctaagtaaagccagtggaaatgaagagtcttccaatcctactgttgctgtgcgtggcagtttgctcagcctatccattggatggagctgcaaggggtgaggacaccagcatgaaccttgttcagaaatatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtgatgcgcaagcccaggtgtggagttcctgatgttggtcacttcagaacctttcctggcatcccgaagtggaggaaaacccaccttacatacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagagaacatggagacttttacccttttgatggacctggaaatgttttggcccatgcctatgcccctgggccagggattaatggagatgcccactttgatgatgatgaacaatggacaaaggatacaacagggaccaatttatttctcgttgctgctcatgaaattggccactccctgggtctctttcactcagccaacactgaagctttgatgtacccactctatcactcactcacagacctgactcggttccgcctgtctcaagatgatataaatggcattcagtccctctatggacctccccctgactcccctgagacccccctggtacccacggaacctgtccctccagaacctgggacgccagccaactgtgatcctgctttgtcctttgatgctgtcagcactctgaggggagaaatcctgatctttaaagacaggcacttttggcgcaaatccctcaggaagcttgaacctgaattgcatttgatctcttcattttggccatctcttccttcaggcgtggatgccgcatatgaagttactagcaaggacctcgttttcatttttaaaggaaatcaattctgggccatcagaggaaatgaggtacgagctggatacccaagaggcatccacaccctaggtttccctccaaccgtgaggaaaatcgatgcagccatttctgataaggaaaagaacaaaacatatttctttgtagaggacaaatactggagatttgatgagaagagaaattccatggagccaggctttcccaagcaaatagctgaagactttccagggattgactcaaagattgatgctgtttttgaagaatttgggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctgtgtagactatttgcttatttaataaagacgatttgtcagtta

SEQ ID NO: 458308 - DNA, 1586 bp, Homo sapiens
  misc_feature (4)..(4): n is a, c, g, or t
tggnaccgccggaagtttctgccgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458309 - DNA, 428 bp, Homo sapiens
aattttcaggaaagggtctaggttgtggttcctttctgtggtttccttcctcagaaaaaatccaagaagtcctctgagacactgactttcaagaggcccgagggcatgcaccgggaagttatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458310 - DNA, 337 bp, Homo sapiens
gcggccgcctactactactattgctcgaattcaagcttctaacgatgtacggcgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458311 - DNA, 878 bp, Homo sapiens
caatcctcgtggcaaatgcatgcagagtaggactctgtgggtcttttctgcccaagggatcctgttctttcccggacctgctctggtttttcatggcttttcttggtctttcaaatgttgctgttcctcagagctgtatcctaggtgctctagtcttcttgttctctactttcttagtatgaaccctgtggcttcagttaccctctctacaagtcaccaatccagagcagtgcttccttcgcatccagtcatttactaatatctctttctcaatgccccacaggtaccttacatcaggtaggtaccctgaacagagctcatcatcttccctctgtcagtcccaaatctgttccccatctcagtgaatggcactatcttccacccagttgcccaaaccagaaacttgggggatcgtccttgacttagtcttctcccttagtcctcacagtatttaaatcaacaacagaacaaagaaggtaggggaaaacaaacaacaaacatgtaaggaaataaattggagtctttcaaataagagccgtcagtaacacgaaaccaggatttgaatggatatgaaatgagataaagagtgaacttgtaggtgtaggggagtcctaccttaggttggtcagggagggtctgagaacgtggcatttgagctggatgccagtgatacatctatttattgagtcctgttgattctttttccataataaatcacatctctgactatattcttcatcactatgccagccccctagtccaagctgagttacctgtgtagctcagcagagcacggccttcccagactcacccattcagtgagaggcagagctagattgggctaggtttcctagtccattacttaagtcattgtacag

SEQ ID NO: 458312 - DNA, 512 bp, Homo sapiens
  misc_feature (13)..(14): n is a, c, g, or t
ctctagaggatcnncacactgggttcgattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagggtaagctaccttcattcggacacaggccaagattgccctcccactttgagccatttgtgcgagctctccagtctcctagggttggttctgggggcacgcttatgcccaactgtgatta

SEQ ID NO: 458313 - DNA, 1622 bp, Homo sapiens
  misc_feature (4)..(4): n is a, c, g, or t
tggnaccgccggaagtttctgccgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccaggaaaaaaaaaaaggggcggggtataaggtttctcagg

SEQ ID NO: 458314 - DNA, 1753 bp, Homo sapiens
  misc_feature (4)..(4): n is a, c, g, or t
tggnaccgccggaagtttctgccgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgctcttgggaaggaggagactgaggcagtcctgagaaagaccagagttggggaccacaggacaaagaccacatccatgtccccacagccatggcaaccctagggcagagccccagccccatggaccactcacgcgactcccattagcactcctccccttgaatcattaaatatgtatatcttattacacgccttg

SEQ ID NO: 458315 - DNA, 1632 bp, Homo sapiens
  misc_feature (4)..(4): n is a, c, g, or t
tggnaccgccggaagtttctgccgcggctttgcggggacgggggagtggtagtgggggctgcagctgccggacccaggtctggattggccccgccccctgacctgagcctggtccttcttcaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458316 - DNA, 1512 bp, Homo sapiens
  misc_feature (4)..(4): n is a, c, g, or t
tggnaccgccggaagtttctgccgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccagctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458317 - DNA, 1681 bp, Homo sapiens
  misc_feature (4)..(4): n is a, c, g, or t
tggnaccgccggaagtttctgccgcggctttgcggggacgggggagtggtagtgggggctgcagctgccggacccaggtgcggaagtgcgagggcccaggtggctgaaggggccgttaggaacatccaagcggtggggcacaggcagatccccgacctgacctggaccacccttctcctcttggcccgccccttcaactcgcctccgcttaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458318 - DNA, 1835 bp, Homo sapiens
  misc_feature (4)..(4): n is a, c, g, or t
tggnaccgccggaagtttctgccgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcggtaagagtctggacaggctgggaggcacgcctgggccctgcgagtgagcacatgcacatgggtgtaggggctcctctccctctagtgcctgcagcaggaacgatcatcacttctgtgcgagtctgagactgagggtaggagtgggttgaccagtgggcgtccttgtccctgagcgtgtgaagcacatgcactaagcctgactcaggccttggggggtcactgacctcaatgccttctgtgtatcctcagagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458319 - DNA, 1276 bp, Homo sapiens
  misc_feature (4)..(4): n is a, c, g, or t
tggnaccgccggaagtttctgccgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccagctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggttggtcctgaccccaaggacaccatcattgatgtggtgggcgcacccctcacgcccaattcgagaaagcgacgggagtcggcctccagctcatcttccgtgaagaaagccaagaagccgtgagaggtcccacaagtttttacaaagaaaatgaccgagcctatgtaaaaaaaaaaaa

SEQ ID NO: 458320 - DNA, 1464 bp, Homo sapiens
  misc_feature (13)..(14): n is a, c, g, or t
ctctagaggatcnncacactgggttcgattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458321 - DNA, 2031 bp, Homo sapiens
  misc_feature (4)..(4): n is a, c, g, or t
tggnaccgccggaagtttctgccgcggctttgcggggacgggggagtggtagtgggggctgcagctgccggacccaggtctggattggccccgccccctgacctgagcctggtccttcttcaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaacaagggctcctgcttgcttagcaggatgcaggaggacctgaagtcttttgctccaggacatgactttcttgctataggggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagagttgacctttggactccacagaagcacttacatgtgggcccctcaccttaactatgggggcaggagtgtgtgtcccatgactgaggctctggagctggagacagtgaagttgatcctggaataaatcagaggcaggctacagtcccaaaccctgctaggacctctagtcaagcagacaagttctttcctcactccatgctgcaggggcacaggcccagggtctggcaacaaacaggagcagctgtggtcactggggcctggagcctgctggacatgacatcatgcgggcatgcccctactgtgtccctctgtgctagtagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458322 - DNA, 2177 bp, Homo sapiens
tattgggattacaggcgtgagccaccgcacatggccctgagttgttggtttgtttgttttttagttaaattgaattaaaatgcataggagaaatatgtaaccaaacctgggaaaccagagagacttcccagaggagatgatgcctgagagctcgaaaggttgagaaagttacctaggtagaaggaatgtggaagtggaaggcatttcaggcaagagcagaggtcaagggggaagtctgctatgttctagaaactgctagtcatttggctgcagtttagggttcatgagggacagtggctgcaggaggaggccaggtcatttatttgtatgttcattaattgatttggtagacactgatacatacagtgtgctgagtcctaaaggtgcgagatgaactggacaacccttgctcttcaggagtttgtgaattatctagaagatgctttatcttagatggagagcttctgaggagtttaataagggatagttgggggtaatgataagatatatattctagaacactaggacagtgtgtctcaaatcatctgtggtgaaggacatttttctattttatttctaaaccatcagagactgataaagataataaaattataaagacaaaatacaagtccatgtttcttcatattagattcaacagcatacaattgctgtaaaattgttacgtaagtttttcagtgtgtactctcagtttccattctcatcatagaccaggggtaagtgtaaacagcactggtttgcagactatcctttaagtagcactgttcaaagagatcacgtcttagctgcagatggagaattgattggaagcggattgaatgtgggcagagatcagtagcgaggctatttctctgatccaggcatgtgacagtgggtaggccgacggagaagtggcaatggagacagaaattttggaggtaaaagccacagatttggtgaaggggaggagtcaaggggaaagataggaattaagatgcctcccaggtttctggcttgagcagctgggttgggtgatggtgatattgactgaaatctggactggagaagataatgtttgagagagggccatgagttcagtactgagctaagtttgaggttccttggggcctccagtaggagatgtccaaaaggcgaccagttttggagctggttgtggtctttaactgagaagagagacttccctgatgtagtctagcactgactccttccttgggtctctgacagactcagctcgtggtagtgctatttgtctctgggggaggtctgtggaagaagggaggaaggggcattggcagggctgcgtatgttggtagtaggattcaggcccagcttctgtagagatgcctgaccttggcaaactctgggggagtggcaagtcccactgtgcccactgggtggcagtagtgcttcagatgagttgtatggactaggggttgctgggcctttctccaggtaattagccatctgtcctactccagagttgacctttggactccacagaagcacttacatgtgggcccctcaccttaactatgggggcaggagtgtgtgtcccatgactgaggctctggagctggagacagtgaagttgatcctggaataaatcagaggcaggctacagtcccaaaccctgctaggacctctagtcaagcagacaagttctttcctcactccatgctgcaggggcacaggcccagggtctggcaacaaacaggagcagctgtggtcactggggcctggagcctgctggacatgacatcatgcgggcatgcccctactgtgtccctctgtgctagtagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcaggccccacggggtgtgggcgacgctgttatgtaaatagagctgctgagttggaccagg

SEQ ID NO: 458323 - DNA, 1110 bp, Homo sapiens
  misc_feature (4)..(4): n is a, c, g, or t
tggnaccgccggaagtttctgccgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataaggtaccttacatcaggtaggtaccctgaacagagctcatcatcttccctctgtcagtcccaaatctgttccccatctcagtgaatggcactatcttccacccagttgcccaaaccagaaacttgggggatcgtccttgacttagtcttctcccttagtcctcacagtatttaaatcaacaacagaacaaagaaggtaggggaaaacaaacaacaaacatgtaaggaaataaattggagtctttcaaataagagccgtcagtaacacgaaaccaggatttgaatggatatgaaatgagataaagagtgaacttgtaggtgtaggggagtcctaccttaggttggtcagggagggtctgagaacgtggcatttgagctggatgccagtgatacatctatttattgagtcctgttgattctttttccataataaatcacatctctgactatattcttcatcactatgccagccccctagtccaagctgagttacctgtgtagctcagcagagcacggccttcccagactcacccattcagtgagaggcagagctagattgggctaggtttcctagtccattacttaagtcattgtacag

SEQ ID NO: 458324 - DNA, 212 bp, Homo sapiens
tgacgccaagaccgcgatcagtagatcgtaatgatcgcctagttacgccatattcgagaaagcgacgggagtcggcctccagctcatcttccgtgaagaaagccaagaagccgtgagaggccccacggggtgtgggcgacgctgttatgtaaatagagctgctgagttggaccaggaaaaaaaaaaaggggcggggtataaggtttctcagg

SEQ ID NO: 458325 - DNA, 181 bp, Homo sapiens
tacaccctttgggctgaagatgcttgggccctagctctggcctggccctaatgctgcctcttccttttcctacctctcccttcctcaggctcttgggaaggaggagactgaggcagtcctgagaaagaccagagttggggaccacaggacaaagaccacatccatgtccccacagccatgg

SEQ ID NO: 458326 - DNA, 444 bp, Homo sapiens
ggggtgctaggactaaccctgggccctctccctgtgacaccttggtctccataatgccttctcccccagggctgttcctgagactgcaggcatcaagtttccagacttcaagtctgcaggtgtcacgctgcggagccaacgggtacgtgagtcacctcctttagcaagtttgggtcctgggctctgctctgggctccatgtgtcccaaacgctgcaggcaggtggggatggagcagtaggagagattgctgcagacagaggtggccttggcaggatctcagtgatgtggccaggctaaggtcatagcagctttcactatattcagcttcctggctatttccttttctggcccatagttaacctccatgtgttaccgtctctcttccaccatctttccctctgccttttgtccccttcatcctaagcctcttgtggctgggacag

SEQ ID NO: 458327 - DNA, 1546 bp, Homo sapiens
  misc_feature (4)..(4): n is a, c, g, or t
tggnaccgccggaagtttctgccgcggctttgcggggacgggggagtggtagtgggggctgcagctgccggacccaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458328 - DNA, 943 bp, Homo sapiens
  misc_feature (572)..(572): n is a, c, g, or t
  misc_feature (622)..(622): n is a, c, g, or t
  misc_feature (664)..(664): n is a, c, g, or t
  misc_feature (671)..(671): n is a, c, g, or t
  misc_feature (697)..(697): n is a, c, g, or t
  misc_feature (716)..(716): n is a, c, g, or t
  misc_feature (721)..(721): n is a, c, g, or t
  misc_feature (726)..(726): n is a, c, g, or t
  misc_feature (728)..(728): n is a, c, g, or t
  misc_feature (733)..(733): n is a, c, g, or t
  misc_feature (738)..(739): n is a, c, g, or t
  misc_feature (748)..(748): n is a, c, g, or t
  misc_feature (779)..(779): n is a, c, g, or t
  misc_feature (793)..(793): n is a, c, g, or t
  misc_feature (802)..(802): n is a, c, g, or t
  misc_feature (810)..(810): n is a, c, g, or t
  misc_feature (852)..(852): n is a, c, g, or t
  misc_feature (877)..(877): n is a, c, g, or t
  misc_feature (916)..(916): n is a, c, g, or t
acgcgtccgcccacgcgtccgggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagataaagacttgttgcaaggttgccttgttgttacttcgggaggcagggagttacacagctgtttattctcccacagattgatngctttgggacttaagggcaagaaaacttgacccaccttctttttgacctncagcccgcccgctttttgaccttgctgttttttgtttgttantccaatngaccgggtaattgaccacccaagcangttcaaaaaaagcggttcnttgtnggaananccttnaaggnngcgggtacntacccacaatcttgttgctaaagctttgccnaaccgttgcggggnttgtgccangcgcacangaccctttaaagataaccaagtattttgattgctggggcacngaacagacgggcgggaagggaacangctttgaggcgtctcctacaaacccgggacccccaagangcacggtgggcacgaaggaaggatgta

SEQ ID NO: 458329 - DNA, 1767 bp, Homo sapiens
  misc_feature (4)..(4): n is a, c, g, or t
tggnaccgccggaagtttctgccgcggctttgcggggacgggggagtggtagtgggggctgcagctgccggacccaggtgcggaagtgcgagggcccaggtggctgaaggggccgttaggaacatccaagcggtggggcacaggcagatccccgacctgacctggaccacccttctcctcttggcccgccccttcaactcgcctccgcttaggtctggattggccccgccccctgacctgagcctggtccttcttcaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458330 - DNA, 1608 bp, Homo sapiens
  misc_feature (4)..(4): n is a, c, g, or t
tggnaccgccggaagtttctgccgcggctttgcggggacgggggagtggtagtgggggctgcagctgccggacccaggtgcggaagtgcgagggcccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458331 - DNA, 1612 bp, Homo sapiens
  misc_feature (4)..(4): n is a, c, g, or t
tggnaccgccggaagtttctgccgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacgggcttagcttgccagctttcattgcagatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458332 - DNA, 1560 bp, Homo sapiens
acgcgtccgcccacgcgtccgggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458333 - DNA, 2888 bp, Homo sapiens
tattgggattacaggcgtgagccaccgcacatggccctgagttgttggtttgtttgttttttagttaaattgaattaaaatgcataggagaaatatgtaaccaaacctgggaaaccagagagacttcccagaggagatgatgcctgagagctcgaaaggttgagaaagttacctaggtagaaggaatgtggaagtggaaggcatttcaggcaagagcagaggtcaagggggaagtctgctatgttctagaaactgctagtcatttggctgcagtttagggttcatgagggacagtggctgcaggaggaggccaggtcatttatttgtatgttcattaattgatttggtagacactgatacatacagtgtgctgagtcctaaaggtgcgagatgaactggacaacccttgctcttcaggagtttgtgaattatctagaagatgctttatcttagatggagagcttctgaggagtttaataagggatagttgggggtaatgataagatatatattctagaacactaggacagtgtgtctcaaatcatctgtggtgaaggacatttttctattttatttctaaaccatcagagactgataaagataataaaattataaagacaaaatacaagtccatgtttcttcatattagattcaacagcatacaattgctgtaaaattgttacgtaagtttttcagtgtgtactctcagtttccattctcatcatagaccaggggtaagtgtaaacagcactggtttgcagactatcctttaagtagcactgttcaaagagatcacgtcttagctgcagatggagaattgattggaagcggattgaatgtgggcagagatcagtagcgaggctatttctctgatccaggcatgtgacagtgggtaggccgacggagaagtggcaatggagacagaaattttggaggtaaaagccacagatttggtgaaggggaggagtcaaggggaaagataggaattaagatgcctcccaggtttctggcttgagcagctgggttgggtgatggtgatattgactgaaatctggactggagaagataatgtttgagagagggccatgagttcagtactgagctaagtttgaggttccttggggcctccagtaggagatgtccaaaaggcgaccagttttggagctggttgtggtctttaactgagaagagagacttccctgatgtagtctagcactgactccttccttgggtctctgacagactcagctcgtggtagtgctatttgtctctgggggaggtctgtggaagaagggaggaaggggcattggcagggctgcgtatgttggtagtaggattcaggcccagcttctgtagagatgcctgaccttggcaaactctgggggagtggcaagtcccactgtgcccactgggtggcagtagtgcttcagatgagttgtatggactaggggttgctgggcctttctccaggtaattagccatctgtcctactccagagttgacctttggactccacagaagcacttacatgtgggcccctcaccttaactatgggggcaggagtgtgtgtcccatgactgaggctctggagctggagacagtgaagttgatcctggaataaatcagaggcaggctacagtcccaaaccctgctaggacctctagtcaagcagacaagttctttcctcactccatgctgcaggggcacaggcccagggtctggcaacaaacaggagcagctgtggtcactggggcctggagcctgctggacatgacatcatgcgggcatgcccctactgtgtccctctgtgctagtagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458334 - DNA, 1985 bp, Homo sapiens
  misc_feature (4)..(4): n is a, c, g, or t
tggnaccgccggaagtttctgccgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaacaagggctcctgcttgcttagcaggatgcaggaggacctgaagtcttttgctccaggacatgactttcttgctataggggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagagttgacctttggactccacagaagcacttacatgtgggcccctcaccttaactatgggggcaggagtgtgtgtcccatgactgaggctctggagctggagacagtgaagttgatcctggaataaatcagaggcaggctacagtcccaaaccctgctaggacctctagtcaagcagacaagttctttcctcactccatgctgcaggggcacaggcccagggtctggcaacaaacaggagcagctgtggtcactggggcctggagcctgctggacatgacatcatgcgggcatgcccctactgtgtccctctgtgctagtagactgtgcaggtgcctgtgtactcggagcaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458335 - DNA, 1556 bp, Homo sapiens
  misc_feature (4)..(4): n is a, c, g, or t
tggnaccgccggaagtttctgccgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataaggagtaccagctttatctccacgatgatgcttggactaaggcagaaactgaccacctctttgacctcagccgccgctttgacctgcgttttgttgttatccatgaccggtatgaccaccagcagttcaagaagcgttctgtggaagacctgaaggagcggtactaccacatctgtgctaagcttgccaacgtgcgggctgtgccaggcacagaccttaagataccagtatttgatgctgggcacgaacgacggcggaaggaacagcttgagcgtctctacaaccggaccccagagcaggtggcagaggaggagtacctgctacaggagctgcgcaagattgaggcccggaagaaggagcgggagaaacgcagccaggacctgcagaagctgatcacagcggcagacaccactgcagagcagcggcgcacggaacgcaaggcccccaaaaagaagctaccccagaaaaaggaggctgagaagccggctgttcctgagactgcaggcatcaagtttccagacttcaagtctgcaggtgtcacgctgcggagccaacggatgaagctgccaagctctgtgggacagaagaagatcaaggccctggaacagatgctgctggagcttggtgtggagctgagcccgacacctacggaggagctggtgcacatgttcaatgagctgcgaagcgacctggtgctgctctacgagctcaagcaggcctgtgccaactgcgagtatgagctgcagatgctgcggcaccgtcatgaggcactggcccgggctggtgtgctagggggccctgccacaccagcatcaggcccaggcccggcctctgctgagccggcagtgactgaacccggacttggtcctgaccccaaggacaccatcattgatgtggtgggcgcacccctcacgcccaattcgagaaagcgacgggagtcggcctccagctcatcttccgtgaagaaagccaagaagccgtgagaggccccacggggtgtgggcgacgctgttatgtaaatagagctgctgagttggaccagg

SEQ ID NO: 458336 - DNA, 634 bp, Homo sapiens
  misc_feature (4)..(4): n is a, c, g, or t
tggnaccgccggaagtttctgccgcggctttgcggggacgggggagtggtagtgggggctgcagctgccggacccaggcactgacccttgacctccggtggctcccccatctctcaggcgcgatggctacgggcgcggatgtacgggacattctagaactcgggggtccagaaggggatgcagcctctgggaccatcagcaagaaggacattatcaacccggacaagaaaaaatccaagaagtcctctgagacactgactttcaagaggcccgagggcatgcaccgggaagtctatgccttgctctactctgacaagaaggatgcacccccactgctacccagtgacactggccagggataccgtacagtgaaggccaagttgggctccaagaaggtgcggccttggaagtggatgccattcaccaacccggcccgcaaggacggagcaatgttcttccactggcgacgtgcagcggaggagggcaaggactacccctttgccaggttcaataagggtaagctaccttcattcggacacaggccaagattgccctcccactttgagccatttgtgcgagctctccagtctcctagggttggttctgggggcacgcttatgcccaactgtgatta

SEQ ID NO: 458337 - DNA, 1772 bp, Homo sapiens
ttcattcaaggcctgggggagctgcggttccgagaagcggcagacggcagccagaaggcttgggctgttgagtaagcagccccctctcagtcccggccctccccgcctcgcgccctgcgcctccagtgagtgactgagcccccgctgcggccccgcccccggggccctgccggagctggtgcgcggcgcggaggggagggccggccaggtaggaatgcgctgcgggcgggcggcgcaggaggcgagcggcggaacatgtaagggcacatcccgcgagctgccgcccagcgcgcagacagagcccaggggagcaagagaacgggcgggcggtggggctcacggcctagggaggcgcggaggcatctggcagaggcgggtcgggctgggccagctggggtagagcggaggagcgggtgccggctgaagcggggcggtgggcgcggagcgcgctgggggcaccgacaccacctcaccggcagccgggtgctgagggccgcggtgtgggtgcgcggagcagtcagggcgcaggtgggcagcgcgcacggcctgccagcccggggcgccagaatcctgcgctgcggggccgagaggggcgccgcgcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctatgcatcttccccccactgcggtgttcggcctgaaggtggtgggggtgagggggggtttggccattagcatttcatgtctttccccaaatgaagatgccctgcaaagggcagtaaccaca

SEQ ID NO: 458338 - DNA, 1866 bp, Homo sapiens
ttcattcaaggcctgggggagctgcggttccgagaagcggcagacggcagccagaaggcttgggctgttgagtaagcagccccctctcagtcccggccctccccgcctcgcgccctgcgcctccagtgagtgactgagcccccgctgcggccccgcccccggggccctgccggagctggtgcgcggcgcggaggggagggccggccaggtaggaatgcgctgcgggcgggcggcgcaggaggcgagcggcggaacatgtaagggcacatcccgcgagctgccgcccagcgcgcagacagagcccaggggagcaagagaacgggcgggcggtggggctcacggcctagggaggcgcggaggcatctggcagaggcgggtcgggctgggccagctggggtagagcggaggagcgggtgccggctgaagcggggcggtgggcgcggagcgcgctgggggcaccgacaccacctcaccggcagccgggtgctgagggccgcggtgtgggtgcgcggagcagtcagggcgcaggtgggcagcgcgcacggcctgccagcccggggcgccagaatcctgcgctgcggggccgagaggggcgccgcgcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctatgcatcttccccccactgcggtgttcggcctgaaggtggtgggggtgaggggttttttcctataatttcatttatttatattatttctttccgtaatatatgattttttgtatttttttaattattgtgtacgttatttatttatattttgttttaatattattgatttatatataaactcttatttagattgttgtatttttagattctttc

SEQ ID NO: 458339 - DNA, 1550 bp, Homo sapiens
ttcattcaaggcctgggggagctgcggttccgagaagcggcagacggcagccagaaggcttgggctgttgagtaagcagccccctctcagtcccggccctccccgcctcgcgccctgcgcctccagtgagtgactgagcccccgctgcggccccgcccccggggccctgccggagctggtgcgcggcgcggaggggagggccggccaggtaggaatgcgctgcgggcgggcggcgcaggaggcgagcggcggaacatccgggtgctgagggccgcggtgtgggtgcgcggagcagtcagggcgcaggtgggcagcgcgcacggcctgccagcccggggcgccagaatcctgcgctgcggggccgagaggggcgccgcgcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctatgcatcttccccccactgcggtgttcggcctgaaggtggtgggggtgagggggggtttggccattagcatttcatgtctttccccaaatgaagatgccctgcaaagggcagtaaccaca

SEQ ID NO: 458340 - DNA, 1616 bp, Homo sapiens
ttcattcaaggcctgggggagctgcggttccgagaagcggcagacggcagccagaaggcttgggctgttgagtaagcagccccctctcagtcccggccctccccgcctcgcgccctgcgcctccagtgagtgactgagcccccgctgcggccccgcccccggggccctgccggagctggtgcgcggcgcggaggggagggccggccaggtaggaatgcgctgcgggcgggcggcgcaggaggcgagcggcggaacatgtaagggcacatcccgcgagctgccgcccagcgcgcagacagagcccaggggagcaagagaacgggcgggcggtggggctcacggcctagggaggcgcggaggcatctggcagaggcgggtcgggctgggccagctgggtgcgcggagcagtcagggcgcaggtgggcagcgcgcacggcctgccagcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctatgcatcttccccccactgcggtgttcggcctgaaggtggtgggggtgagggggggtttggccattagcatttcatgtctttccccaaatgaagatgccctgcaaagggcagtaaccaca

SEQ ID NO: 458341 - DNA, 1738 bp, Homo sapiens
ttcattcaaggcctgggggagctgcggttccgagaagcggcagacggcagccagaaggcttgggctgttgagtaagcagccccctctcagtcccggccctccccgcctcgcgccctgcgcctccagtgagtgactgagcccccgctgcggccccgcccccggggccctgccggagctggtgcgcggcgcggaggggagggccggccaggtaggaatgcgctgcgggcgggcggcgcaggaggcgagcggcggaacatgtaagggcacatcccgcgagctgccgcccagcgcgcagacagagcccaggggagcaagagaacgggcgggcggtggggctcacggcctagggaggcgcggaggcatctggcagaggcgggtcgggctgggccagctggggtagagcggaggagcgggtgccggctgaagcggggcggtgggcgcggagcgcgctgggggcaccgacaccacctcaccggcagccgggtgctgagggccgcggtgtgggtgcgcggagcagtcagggcgcaggtgggcagcgcgcacggcctgccagcccggggcgccagaatcctgcgctgcggggccgagaggggcgccgcgcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctatgcatcttccccccactgcggtgttcggcctgaaggtggtgggggtgagggggggtttggccattagcatttcatgtctttccccaaatgaagatgccctgcaaagggcagtaaccaca

SEQ ID NO: 458342 - DNA, 1739 bp, Homo sapiens
ttcattcaaggcctgggggagctgcggttccgagaagcggcagacggcagccagaaggcttgggctgttgagtaagcagccccctctcagtcccggccctccccgcctcgcgccctgcgcctccagtgagtgactgagcccccgctgcggccccgcccccggggccctgccggagctggtgcgcggcgcggaggggagggccggccaggtaggaatgcgctgcgggcgggcggcgcaggaggcgagcggcggaacatgtaagggcacatcccgcgagctgccgcccagcgcgcagacagagcccaggggagcaagagaacgggcgggcggtggggctcacggcctagggaggcgcggaggcatctggcagaggcgggtcgggctgggccagctggggtagagcggaggagcgggtgccggctgaagcggggcggtgggcgcggagcgcgctgggggcaccgacaccacctcaccggcagccgggtgctgagggccgcggtgtgggtgcgcggagcagtcagggcgcaggtgggcagcgcgcacggcctgccagcccggggcgccagaatcctgcgctgcggggccgagaggggcgccgcgcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctatgcatcttccccccactgcggtgttcggcctgaaggtggtgggggtgagggggggtttggccattagcatttcatgtctttccccaaatgaagatgccctgcaaagggcagtaaccaca

SEQ ID NO: 458343 - DNA, 1582 bp, Homo sapiens
ttcattcaaggcctgggggagctgcggttccgagaagcggcagacggcagccagaaggcttgggctgttgagtaagcagccccctctcagtcccggccctccccgcctcgcgccctgcgcctccagtgagtgactgagcccccgctgcggccccgcccccggggccctgccggagctggtgcgcggcgcggaggggagggccggccaggtaggaatgcgctgcgggcgggcggcgcaggaggcgagcggcggaacatgtaagggcacatcccgcgagctgccgcccagcgcgcagacagagcccaggggagcaagagaacgggcgggcggtggggctcacggcctagggaggcgcggaggcatctggcagaggcgggtcgggctgggccagctgggtgcgcggagcagtcagggcgcaggtgggcagcgcgcacggcctgccagcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctatgcatcttccccccactgcggtgttcggcctgaaggtggtgggggtgagggggggtttggccattagcatttcatgtctttccccaaatgaagatgccctgcaaagggcagtaaccaca

SEQ ID NO: 458344 - DNA, 504 bp, Homo sapiens
caagatgaacgacgactcggttattcatcactgtgctgggttgttattatggtcgtgggctacgaatagagccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctatgcatcttccccccactgcggtgttcggcctgaaggtggtgggggtgagggggggtttggccattagcatttcatgtctttccccaaatgaagatgccctgcaaagggcagtaaccaca

SEQ ID NO: 458345 - DNA, 1995 bp, Homo sapiens
ttcattcaaggcctgggggagctgcggttccgagaagcggcagacggcagccagaaggcttgggctgttgagtaagcagccccctctcagtcccggccctccccgcctcgcgccctgcgcctccagtgagtgactgagcccccgctgcggccccgcccccggggccctgccggagctggtgcgcggcgcggaggggagggccggccaggtaggaatgcgctgcgggcgggcggcgcaggaggcgagcggcggaacatgtaagggcacatcccgcgagctgccgcccagcgcgcagacagagcccaggggagcaagagaacgggcgggcggtggggctcacggcctagggaggcgcggaggcatctggcagaggcgggtcgggctgggccagctggggtagagcggaggagcgggtgccggctgaagcggggcggtgggcgcggagcgcgctgggggcaccgacaccacctcaccggcagccgggtgctgagggccgcggtgtgggtgcgcggagcagtcagggcgcaggtgggcagcgcgcacggcctgccagcccggggcgccagaatcctgcgctgcggggccgagaggggcgccgcgcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctatgcatcttccccccactgcggtgttcggcctgaaggtggtgggggtgagggggggtttggccattagcatttcatgtctttccccaaatgaagatgccctgcaaagggcagtaaccacaaaaaaaaaaaaaaaaaaaagaaaaaacaacaaacagaggacaggagcaacaaaaagagaagagaggaaagaaaacagggcagtaagaaaaaagggacgagagagagaaaagagtggattcacgtcgccaaacgttttgtgaatcaagatgttgaaaaatagagggatacactaaagtgagagcgagataaaatgtcatagaagaggagaaaaaccgctataag

SEQ ID NO: 458346 - DNA, 1496 bp, Homo sapiens
gagagaacggggcgtgctgggttcgagggatcagggactacaggcaggcgcccaggaatgtgagaccgaggcgggtagccctgggactggctgaagggtaggagacgagagaggggcgtctgccgaggtagtcctcgggacggatggagcgctgagcgactgtgtggggcaccttgatccctaatcggtcagaggaagctcgcgttgtggaaggtgcacgagtgttgggtgcgcggagcagtcagggcgcaggtgggcagcgcgcacggcctgccagcccggggcgccagaatcctgcgctgcggggccgagaggggcgccgcgcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctatgcatcttccccccactgcggtgttcggcctgaaggtggtgggggtgagggggggtttggccattagcatttcatgtctttccccaaatgaagatgccctgcaaagggcagtaaccaca

SEQ ID NO: 458347 - DNA, 1364 bp, Homo sapiens
ttcattcaaggcctgggggagctgcggttccgagaagcggcagacggcagccagaaggcttgggctgttgagtaagcagccccctctcagtcccggccctccccgcctcgcgccctgcgcctccagtgagtgactgagcccccgctgcggccccgcccccggggccctgccggagctggtgcgcggcgcggaggggagggccggccaggtaggaatgcgctgcgggcgggcggcgcaggaggcgagcggcggaacatgtaagggcacatcccgcgagctgccgcccagcgcgcagacagagcccaggggagcagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctatgcatcttccccccactgcggtgttcggcctgaaggtggtgggggtgagggggggtttggccattagcatttcatgtctttccccaaatgaagatgccctgcaaagggcagtaaccaca

SEQ ID NO: 458348 - DNA, 1884 bp, Homo sapiens
  misc_feature (1683)..(1683): n is a, c, g, or t
ttcattcaaggcctgggggagctgcggttccgagaagcggcagacggcagccagaaggcttgggctgttgagtaagcagccccctctcagtcccggccctccccgcctcgcgccctgcgcctccagtgagtgactgagcccccgctgcggccccgcccccggggccctgccggagctggtgcgcggcgcggaggggagggccggccaggtaggaatgcgctgcgggcgggcggcgcaggaggcgagcggcggaacatgtaagggcacatcccgcgagctgccgcccagcgcgcagacagagcccaggggagcaagagaacgggcgggcggtggggctcacggcctagggaggcgcggaggcatctggcagaggcgggtcgggctgggccagctggggtagagcggaggagcgggtgccggctgaagcggggcggtgggcgcggagcgcgctgggggcaccgacaccacctcaccggcagccgggtgctgagggccgcggtgtgggtgcgcggagcagtcagggcgcaggtgggcagcgcgcacggcctgccagcccggggcgccagaatcctgcgctgcggggccgagaggggcgccgcgcccgccgcagcctggagctttccgcgaacctcggggcgcccatgacggcggcggcgacggctaccgtgctcaaggagggcgtgctggagaagcgcagcggcgggctgctgcagctgtggaagcggaagcgctgcgtcctcaccgaacgcgggctgcagctcttcgaggccaagggcacgggcggccggcccaaggagctcagcttcgcccgcatcaaggccgtggagtgcgtggagagcaccgggcgccacatctacttcacgctggtgaccgaagggggcggcgagatcgacttccgctgccccctggaagatcccggctggaacgcccagatcaccctaggcctggtcaagttcaagaaccagcaggccatccagacagtgcgggcccggcagagcctcgggaccgggaccctcgtgtcctaaaccaccgggcgcaccatctttccttcatgctacccaccacctcagtgctgaggtcaaggcagcttcgttgttccctctggcttgtgggggcacggctgtgctccatgtggcaaggtggaaggcatggacgtgtggaggaggcgctggagctgaaggaatggacgagccctgggaggagggcagaaggctacgcagggctgaggatgaagatgcagcccctggatggtcccagactctcaggacatgcccagctcaggggcttcgagccacaggcctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaaggctacgcagggctgaggatgaagatgcagcccctggatggtcccagactctcaggacatgcccagctcaggggcttcgagccacaggcctggcctcatatggcatgagggggagctggcattaggagccccctccctgctntgggggtctcctgctgcttaggtccttttgggacccccacccatccaggccctttctttgcacacttcttcccccacctctatgcatcttccccccactgcggtgttcggcctgaaggtggtgggggtgagggggggtttggccattagcatttcatgtctttccccaaatgaagatgccctgcaaagggcagtaaccaca

SEQ ID NO: 458349 - DNA, 501 bp, Homo sapiens
taaattcgcggccgcgtcgacgaggcatctggcctcatatggcatgagggggagctggcataggagccccctccctgctgtggtcctgccctctgtcctgcagactgctcttagccccctggctttgtgccaggcctggaggagggcagtcccccatggggtgccgagccaacgcctcaggaatcaggaggccagcctggtaccaaaaggagtacccagggcctggtacccaggcccactccagaatggcctctggactcaccttgagaagggggagctgctgggcctaaagcccactcctgggggtctcctgctgcttaggtccttttgggacccccacccatccaggccctttctttgcacacttcttcccccacctctatgcatcttccccccactgcggtgttcggcctgaaggtggtgggggtgagggggggtttggccattagcatttcatgtctttccccaaatgaagatgccctgcaaagggcagtaaccaca

SEQ ID NO: 458350 - DNA, 186 bp, Homo sapiens
gcggccgcctactactactactactgctcgaattcaagcttctaacgatgtacggggaccgccgcggtggctaccgccagcagcagtctcagacggcctactgagctctccactctgtttcccgcctgggccatccaaccttgaagtcctaaaccacacctcagtcactaaaggtctgtttaaagt

SEQ ID NO: 458351 - DNA, 3126 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458352 - DNA, 165 bp, Homo sapiens
ggatttgctggtgcagtacaactaggcttaatagggaccgccgcggtggctaccgccagcagcagtctcagacggcctactgagctctccactctgtttcccgcctgggccatccaaccttgaagtcctaaaccacacctcagtcactaaaggtctgtttaaagt

SEQ ID NO: 458353 - DNA, 3324 bp, Homo sapiens
  misc_feature (3035)..(3035): n is a, c, g, or t
  misc_feature (3039)..(3039): n is a, c, g, or t
gggcctgcggtgtgactcgcgggctcagctggttggtattttttgggcctcgtgcttcgtggtgggagacccaggtcgaggtccgggtggggccggtgaggggttgggcgtcgggaggtgttggctcgggcctcttcgcgtggccggtgacgccttggctcccccgcagggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagtaaaaaaaaaanaaanaaactccagactagttctctctctttctccctcgttgccgaattcggcccgagggacttgttgcaccccgaaagacggactacctggctgtgaaagaggctggtacaggcgtgtccccaagcctgacctgacctgcaccaggctgccctcggacatgaaagggccgcgtggggaaaaggcctgtgccccaggtacccccactaagaggctgaaaatttaccaagcaaggggccaggaccaaagggtcgtaaatggccatgaaggggacccccataaggtcacgac

SEQ ID NO: 458354 - DNA, 992 bp, Homo sapiens
aagcagtggtatcaacgcaggactggccattactggtgggactacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagtaaaaacaacacaaaaaaaaaaacttttgtgggcccgccttggagcctatgaaaaaggttttcaagacccaatttcggttggcgcggcgggggccccaagtaggttagggtgacacattggtcaaaaagattggttccctaaggaagatcgtgggcaatgcacttagggtcgttgggattcctcaccaaataaaaaaaaaccgcccgggggggcaaaccagagcggttcctgaaacaactcaagatggagggtcaggagggccaattcctggaacctatcccacacgggatgtcccaggcgaggtccgataataaaattacggcccgcgcccgggggaaagagcacaacacgacacagcacaacagaacgcgaccagaaacagtaacaaagcagaacacaaaaaagaacacgaagagggcacgacacgacgggcggcgggcgaggagagagaacacgaaggagacaacgaggacacagcacccgcgagccacaggcgcaagagcaagaacgaccgccaagctgcgacgacagacagaaccaggcaaaagagaagggaaaaaagaaggaccgagagcacacgtaaaggcagcccaagaaaagaagcacgagcagaaagcgagagcccaagacaaggagaactaagacggccggctaccgaaggcacgaacgacgtaaggagcagacgacagccgaacacaaaaaagccagagaagaaagcgaaccagaacgacgcgccaccaaggacctcagcagagcagagagaaagaagggaggg

SEQ ID NO: 458355 - DNA, 762 bp, Homo sapiens
  misc_feature (704)..(704): n is a, c, g, or t
  misc_feature (728)..(729): n is a, c, g, or t
ggacggcaaacagaatgttgtatgagtgcggtacctggttgttatttcaggtccggagggcgggctttctgtgttcgtgtccgtgggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagtatggccttagttgactgaaatatttgatcgtcaggctgtngggtttcacatgggaatttcaggnnagtgaggttgccaataagaacaagcttgtattt

SEQ ID NO: 458356 - DNA, 403 bp, Homo sapiens
ctgtgaactctttttctttttttctttttttttttttttttagatggagtcttgctgtgttgcccaggctggagtgcagtggtgcaatctcatctcactgcaacctccgcctccctggttcaagcagttctcctcagcctcccaagtagctgggattacagggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggtgagggtttcagaggtaaaatgaattggggaacagtttgggaggacataaaggtccccttgtggggaaaaggcaaggacag

SEQ ID NO: 458357 - DNA, 895 bp, Homo sapiens
ctgccagccccagtgtgtggttcccagcctgacaaccttggcaccccagcaccccagcaggaggggtttctgcttgtggtcccctggccaccagcctcggccagctggttgtggaccagccgtgacctggggcaacccagccaacctcaccgtccaatgggctgcagccacctctctccagtgaggtctgagacccagccttaacgaggctacccccttccagcttccagcagccggtccctgaacactcctcctctccctccttggcctcgctgacctcagagttggggacccggaggccggcgtcgatacactgctgcatggggaacttggccttggtggggtccatcttgctgcatttgcgcgtccttcgcattgaagcccttttggagttcctcaggggggaactcgtcacctccacgggttccaggccatcagggccaagctgcttcttgagctcctcctcctagtactcctgctccacctgctttctagacgcgcagcttggcgcagccccgcacaggctccgtggaggcttccagctcgtccttgaagctctccatgcactagcagtcagccgtctgaatctcagtgaagaactgccagaagcagacccgggggaccccttccggctcctgaccaacaccaggttgaactgcgtgacaattgcctagtggaccacctgctccatgagggcgcatttctcctgcacctctagatcagcacaccagatgaccagaaagagaacgagacaagcaatctctttctccaccaagtggggatacagcaagaaggcagctgtgagcaaaccagaaacagagccctcaccagacaccaaatcggtttgccagcaccttaatcttggacttcccagctccagagaactgtgaaaaat

SEQ ID NO: 458358 - DNA, 3106 bp, Homo sapiens
ggaaataaggctaggtaagaggctgggtggagaattgtgcgagggcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458359 - DNA, 3231 bp, Homo sapiens
  misc_feature (2942)..(2942): n is a, c, g, or t
  misc_feature (2946)..(2946): n is a, c, g, or t
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagtaaaaaaaaaanaaanaaactccagactagttctctctctttctccctcgttgccgaattcggcccgagggacttgttgcaccccgaaagacggactacctggctgtgaaagaggctggtacaggcgtgtccccaagcctgacctgacctgcaccaggctgccctcggacatgaaagggccgcgtggggaaaaggcctgtgccccaggtacccccactaagaggctgaaaatttaccaagcaaggggccaggaccaaagggtcgtaaatggccatgaaggggacccccataaggtcacgac

SEQ ID NO: 458360 - DNA, 3079 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccagcctccgcggaaatggccctggttgagaaacactgtactaggtcctatgctaaacattaacatacattgtcagattttgtgctcttatagagtttctcttagagacttataaagttccatgagagcatggtccttgatgatgtctctcactatggactatcagagcttctcagttcctaggccattcaacgcctccg

SEQ ID NO: 458361 - DNA, 3224 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggtgagcagacagagaggccgtgatgggtcggggaagaagagactggttggtccccttccctgaggccctgttgtgtcttctgtcccctcttcccacaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458362 - DNA, 3221 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgaggtgagtacttcggctcctctccttgcccactcctggtgccctcaccgcctctcacctggcattccctgcccttccttcccatctctctcctacagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458363 - DNA, 2802 bp, Homo sapiens
  misc_feature (2697)..(2697): n is a, c, g, or t
  misc_feature (2704)..(2704): n is a, c, g, or t
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcttggccgaaactggcgccggtgggaaccccgcngggtgtngccccgcggccccggggctcccgcccgggggtcccgacggcctcccgggtcccaattcaccacagcccctccggcactgtccccttcgtttgtaaccc

SEQ ID NO: 458364 - DNA, 2737 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagctctgtttcccgcctgggccatccaaccttgaagtcctaaaccacacctcagtcactaaaggtctgtttaaagt

SEQ ID NO: 458365 - DNA, 2542 bp, Homo sapiens
cggacgcgtgggtcgacccacgtcgtcgagatgctgagaaaaatgaggaggattcagtaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458366 - DNA, 3072 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccgatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458367 - DNA, 2620 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcctggcgcctccagggtaccggtcgatctacgcttctgtttttttataaaagaaaaaaa

SEQ ID NO: 458368 - DNA, 2420 bp, Homo sapiens
ataggctaggtacgaggctggggtgaaatcggccgagggctgtcagggcgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458369 - DNA, 2590 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggacctttatccaggtctgcatgcggttagacgacaggagagtctgggaccaccttagcaaggggtctagtccgcctggtgcgcaacgttgtctgtggcccggccatcaagtatagtaggcctccacacatgtgatgtcccatatcttttgctgttttcttctcttcctcttgtgtctggacgcag

SEQ ID NO: 458370 - DNA, 2616 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgcctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458371 - DNA, 2603 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458372 - DNA, 2132 bp, Homo sapiens
ataggctaggtacgaggctggggtgaaatcggccgagggctgtcagggcgagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458373 - DNA, 2464 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagt

SEQ ID NO: 458374 - DNA, 1561 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaagccacaaacggaggaccgagctcgaa

SEQ ID NO: 458375 - DNA, 1697 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458376 - DNA, 1062 bp, Homo sapiens
ccatcagctcctcattaatgatcattttgctgatgatgataaaactgcgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458377 - DNA, 1440 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagt

SEQ ID NO: 458378 - DNA, 1200 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtctgcccagattgagctcgcatctgttcagatccagcgatacacctcgcgcag

SEQ ID NO: 458379 - DNA, 1667 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaaatgtgaatcagtcactactgggaactggacaaaatgggcactgacaaaaatgagcccaattgggtgacttcattgaggacacattacttgaatgagcaggtgaaagccatcaagaatcgggtgaacacgtgaccaattgtgcaagatggaaggcgattcgggtgggggaaattcttgggaagacaccggggaaaggctatgaagagaagcgcggaaatcccagacgggggagagccccgggccacaggggagccagtagggagcagaacacaccatacaaggcgaaaacaccacaaacggaggcaccccccaagaacgggccagcacaaagacaagcaggcaagccaagaagaccgcgacagccgaaacacaaaacacagaagacaacaagacccaagccaggagtcgcacagaaacagcaaaccaccacggtcctcacgacaccatacgccgaacagaagc

SEQ ID NO: 458380 - DNA, 838 bp, Homo sapiens
  misc_feature (786)..(786): n is a, c, g, or t
  misc_feature (815)..(815): n is a, c, g, or t
  misc_feature (831)..(831): n is a, c, g, or t
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgggattgattgaaagaatgaaggacttccanaaaaaattttcccgaaaaatgattgaaanacttggggaccaccanggtttcc

SEQ ID NO: 458381 - DNA, 743 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcacttccctgtacgcagacgttcgaaaccgctgcggggccaagctcacatgcctcccgtcgatt

SEQ ID NO: 458382 - DNA, 576 bp, Homo sapiens
cttccagcagccggtccctgaacactcctcctctccctccttggcctcgctgacctcagagttggggacccggaggccggcgtcgatacactgctgcatggggaacttggccttggtggggtccatcttgctgcatttgcgcgtccttcgcattgaagcccttttggagttcctcaggggggaactcgtcacctccacgggttccaggccatcagggccaagctgcttcttgagctcctcctcctagtactcctgctccacctgctttctagacgcgcagcttggcgcagccccgcacaggctccgtggaggcttccagctcgtccttgaagctctccatgcactagcagtcagccgtctgaatctcagtgaagaactgccagaagcagacccgggggaccccttccggctcctgaccaacaccaggttgaactgcgtgacaattgcctagtggaccacctgctccatgagggcgcatttctcctgcacctctagatcagcacaccagatgaccaggtagttgaccatcttctcatcaggcttggtgttcaccatgctcctgctaaagccgtcttt

SEQ ID NO: 458383 - DNA, 278 bp, Homo sapiens
cagtgtgtggttcccagcctgacaaccttggcaccccagcaccccagcaggaggggtttctgcttgtggtcccctggccaccagcctcggccagctggttgtggaccagccgtgacctggggcaacccagccaacctcaccgtccaatgggctgcagccacctctctccagtgaggtctgagacccagccttaacgaggctacccccttccaggtttgttctttctctgggctctctccctcaccctttgggtgttttttggttgttgttgtttgcgt

SEQ ID NO: 458384 - DNA, 839 bp, Homo sapiens
  misc_feature (31)..(31): n is a, c, g, or t
  misc_feature (37)..(38): n is a, c, g, or t
ccagtaatctcagggttataggtacgaggcngggtgnngcaggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgttacgatgcgggccgagatcccaatgtggactgggcccggtccactttcgtccagcgggggcaaggaacaccgggccaatatcatacc

SEQ ID NO: 458385 - DNA, 409 bp, Homo sapiens
  misc_feature (88)..(88): n is a, c, g, or t
  misc_feature (125)..(125): n is a, c, g, or t
  misc_feature (147)..(147): n is a, c, g, or t
  misc_feature (180)..(180): n is a, c, g, or t
  misc_feature (354)..(354): n is a, c, g, or t
tgccaaaaggccccttcccacgtccctcgagctctgtagcctggtctgtgcattgtggctgtcaaatccatgtgtcccccctgtggtntgtgtgtgacaccaccactgtgtcccagtgtttggcncagccatggctggatgtgcatntggcctatgaccctgtgcctgtgtttcatgttntgtgtcacgtgaccctgtgccccgcctcccggggtgcccgtgtggcctgggtcctcggccctgtagccctggcccggtcccagtccggtgccttccaccctgccctggcctaccacagctgcctccggcctcggcctggcttcaccgcattccagggctgcagccccctgcttntcccgcaccttgaagtcctaaaccacacctcagtcactaaaggtctgtttaaagt

SEQ ID NO: 458386 - DNA, 303 bp, Homo sapiens
aattcgcggccgcgtcgacaagacgacagaagggagagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagt

SEQ ID NO: 458387 - DNA, 3103 bp, Homo sapiens
  misc_feature (25)..(25): n is a, c, g, or t
gccactatcatagtcgaggccgggngtgaatcggcacgagggcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458388 - DNA, 2931 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagt

SEQ ID NO: 458389 - DNA, 3288 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagtttaaaaaaaaaaaaaaaaaaaaaaaaacaaaaacaaaaaaaaaaaacacaaaaaaagaagggagaccagacgcctaacaactagtaccccttaagaagggccgcaaaagcgcgggggccccgaccagtttcttactcacaagaggggcgcgcaccacattaatagacgcgtgtcgatctatttagaattcttatcgaaataggcggcgcggagcgtatatataaaccatgccgtcttagtaataatagtaataaatatgtcatccctcttcgtgtcagttttttttttaacagacagacctctctttatctactcagcggagtggtgctccaatattttgcgtaactaccaccaagt

SEQ ID NO: 458390 - DNA, 3429 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccatagtgactgaggtgtggtttaggacttcaaacttcgggcggaggctgagcgccggcggcgaggcagcggcggactcggggccgcggcggagtcgaggcattgcacctgggcttcggagcgtagcgccagggcctgagccctttgaagcaggagcgagcgggaggcagaccagctgggggcgtccatcatactccggcaaaaccccaataccaccatgctggtacctcctgacccagcgcagcccggacggacgcacggcgctactgccggcaagcgacgacggccagcagacccgaacgaaacgaaatggcccccggcccactacagctccccagccccctgagtaatgagagccagaccacagacaggcaccagcctcccagcgcatcgttgctgcagcacgggccccgccccgacgacccaatacagatcagaaaacgagcagacagaatccggactatacaaaacacccccggccttaacaacaacacaacaccaaggcagcagactaaccaaccaagaacgcacggcaaccacaagacatact

SEQ ID NO: 458391 - DNA, 2613 bp, Homo sapiens
atggctagtgggcgggggtagcgaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458392 - DNA, 2930 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatccacgccggtcggtccctggaacatttttattgtaagacggattgtggtttaaaatatggttttaaaaaaaaccagaaaataaaatagtcattttatgtgctcccgtcaaaaaaggtatgtttaaaa

SEQ ID NO: 458393 - DNA, 3070 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458394 - DNA, 2482 bp, Homo sapiens
gtgatcatagtacgacccgggtgtattcatgcagagggtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458395 - DNA, 3029 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggtgagcagacagagaggccgtgatgggtcggggaagaagagactggttggtccccttccctgaggccctgttgtgtcttctgtcccctcttcccacaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagt

SEQ ID NO: 458396 - DNA, 3262 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagcctcggggaaaaggtcccacactttcccattcatcttctcattgatgataaaactgtgactggaagacctgtcacagttttatcatcaatgagaagatgaatgggaaagctgcgaccttccccctcagacacccacaattaattgtttccaatcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattctttgttgtaatcgttttttttagaaggtaaacaaatttaataaagctaccaataatgttaaaaaaaaaaaaaaaaaaaaaaaaaaaaaaggggggggcacgataaagaagagaataccccacgagaggggcacccaaggaactatcagcggcatccccacaggagattccctggctaccaacaggggggggcccccccaaataagacggaacgacgacgtacatataaacaggacaaagggcaacgtgagccgcacgaggtgacacaagccggtcgggaaaggggggcaaa

SEQ ID NO: 458397 - DNA, 2727 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggcactcatgtcagacatgtttgagcggcatctgcccacctgtgcacgccagcagctcgcaatatgatcaattcatcaggtactgatcacctacctggaccagacaacacagacctgtctatgctctcgacttctggtcagctatgtgtgagacgatctgcgtacggcgcgagtgaccacaaccaggtaatgatcgggtattactttga

SEQ ID NO: 458398 - DNA, 2509 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggacctttctggccacgactatgaccaagattgcgacatcgtgcttagtaagatccagcaagagacgctggagacttacattctaaattaacgcgggcttgggaa

SEQ ID NO: 458399 - DNA, 2408 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagt

SEQ ID NO: 458400 - DNA, 2041 bp, Homo sapiens
tgaggaggccgggggcgacccgggcgaggagagccacaggcacgaggcaagaagggaacgactgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458401 - DNA, 1687 bp, Homo sapiens
  misc_feature (1608)..(1608): n is a, c, g, or t
  misc_feature (1611)..(1612): n is a, c, g, or t
  misc_feature (1614)..(1614): n is a, c, g, or t
  misc_feature (1617)..(1617): n is a, c, g, or t
  misc_feature (1627)..(1627): n is a, c, g, or t
  misc_feature (1630)..(1631): n is a, c, g, or t
  misc_feature (1635)..(1635): n is a, c, g, or t
  misc_feature (1637)..(1637): n is a, c, g, or t
  misc_feature (1639)..(1639): n is a, c, g, or t
  misc_feature (1648)..(1648): n is a, c, g, or t
  misc_feature (1654)..(1655): n is a, c, g, or t
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtgcgantanngnggnttcggcctanaannttgntnangcctagaangacccnngggcccaaatggaacggaaaaaggggaccgtt

SEQ ID NO: 458402 - DNA, 1767 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacggggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatacttctgagctgctaccacatgacagacacaaggctcagatgaagaggtgaattgaacacgttcctgacctcaaagagcctgctgctttttgacatttaacagaaaattatagtaacataagttataatgggtgt

SEQ ID NO: 458403 - DNA, 1470 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctccatggtgctgcatcctccatggtgctga

SEQ ID NO: 458404 - DNA, 1367 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctcttgataatcaacagcatgggtgatctcagttcccttgggaaacattttcggcttctccttaagcaacggcactccgtcccggactctttcccactccccgccttcattgtcctc

SEQ ID NO: 458405 - DNA, 956 bp, Homo sapiens
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaacacccaccacagatgagacacgagttcaggggatactctagaacagccacacgcagcacggtgcactgcgcgt

SEQ ID NO: 458406 - DNA, 753 bp, Homo sapiens
  misc_feature (695)..(695): n is a, c, g, or t
  misc_feature (719)..(720): n is a, c, g, or t
ataggctaggtacgaggctggggtgaaatcggccgagggctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagtatggccttagttgactgaaatatttgatcgtcaggctgtngggtttcacatgggaatttcaggnnagtgaggttgccaataagaacaagcttgtattt

SEQ ID NO: 458407 - DNA, 1212 bp, Homo sapiens
ggactctcacgtgaccaggagtcgacgtgtgcagaagtccttatagtccagggcctgtttccctgtagcagctccttattgctggagaaggagaaaagtgcccaagatcctttcaggatatttggttttttgggcgcgacacaaatcgaggtgagggaagagagaggaaaatcccctgaatccctgcaggattaatttattcaaaaaggaaataaaaaatactcaatatgcaaaagtcttgtgaagaaaatgagggaaaaccacagaacatgccaaaggccgaggaagatcgccctttggaggatgtaccacaggaggcagaaggaaatcctcaaccttccgaagaaggcgtaagccaggaagcagaaggaaaccccagaggagggccgaatcagcctggccagggatttaaagaggacacacccgttaggcatttggaccctgaagaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagata

SEQ ID NO: 458408 - DNA, 1139 bp, Homo sapiens
ggactctcacgtgaccaggagtcgacgtgtgcagaagtccttatagtccagggcctgtttccctgtagcagctccttattgctggagaaggagaaaagtgcccaagatcctttcaggattaatttattcaaaaaggaaataaaaaatactcaatatgcaaaagtcttgtgaagaaaatgagggaaaaccacagaacatgccaaaggccgaggaagatcgccctttggaggatgtaccacaggaggcagaaggaaatcctcaaccttccgaagaaggcgtaagccaggaagcagaaggaaaccccagaggagggccgaatcagcctggccagggatttaaagaggacacacccgttaggcatttggaccctgaagaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagata

SEQ ID NO: 458409 - DNA, 1138 bp, Homo sapiens
ggactctcacgtgaccaggagtcgacgtgtgcagaagtccttatagtccagggcctgtttccctgtagcagctccttattgctggagaaggagaaaagtgcccaagatcctttcaggatatttggttttttgggcgcgacacaaatcgaggtgagggaagagagaggaaaatcccctgaatccctgcaggattaatttattcaaaaaggaaataaaaaatactcaatatgcaaaagtctggaggcagaaggaaatcctcaaccttccgaagaaggcgtaagccaggaagcagaaggaaaccccagaggagggccgaatcagcctggccagggatttaaagaggacacacccgttaggcatttggaccctgaagaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagata

SEQ ID NO: 458410 - DNA, 1109 bp, Homo sapiens
ggactctcacgtgaccaggagtcgacgtgtgcagaagtccttatagtccagggcctgtttccctgtagcagctccttattgctggagaaggagaaaagtgcccaagatcctttcaggatatttggttttttgggcgcgacacaaatcgaggtgagggaagagagaggaaaatcccctgaatccctgcaggattaatttattcaaaaaggaaataaaaaatactcaatatgcaaaagtcttgtgaagaaaatgagggaaaaccacagaacatgccaaaggccgaggaagatcgccctttggaggatgtaccacagacacacccgttaggcatttggaccctgaagaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagata

SEQ ID NO: 458411 - DNA, 931 bp, Homo sapiens
ggactctcacgtgaccaggagtcgacgtgtgcagaagtccttatagtccagggcctgtttccctgtagcagctccttattgctggagaaggagaaaagtgcccaagatcctttcaggattaatttattcaaaaaggaaataaaaaatactcaatatgcaaaagtctaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagata

SEQ ID NO: 458412 - DNA, 1010 bp, Homo sapiens
ggactctcacgtgaccaggagtcgacgtgtgcagaagtccttatagtccagggcctgtttccctgtagcagctccttattgctggagaaggagaaaagtgcccaagatcctttcaggatatttggttttttgggcgcgacacaaatcgaggtgagggaagagagaggaaaatcccctgaatccctgcaggattaatttattcaaaaaggaaataaaaaatactcaatatgcaaaagtctaaaaaaaaaaaaaaaaaaaaaaaaaaaaaaaaaacatttgtgggcggccctgggcccctggaaaaagttttttaaacaaatcctgttggggggggggcccccggggtggggaactgggccaacaggggggttcccaaagggaaaccccgggcgccaatggacataggcgccggggttccccaccaaaaaaaaaacagccggggggagcccggagcgtgtctgtagaacaaacacccgagagggagaggtcccggagggcccaccacggggctcctatcacacgagggagtctcaaagggagacgttcagataattacaaatacgccccggcgtagtgggaacaacgacagacacaaaacaagcgcaagacctctacaccagaaccacagcagagagcaaacgaaacaggaacagaacagccaccgacagtcagcaacagcaaacagaaaagcgcagacccacaggagcaaacaacgcagaccatcacgaaaaacacgggcggacaaacaacacacccgcgagaacaaacgcacaaggagcaaccggaccacagccacgcgcggcaccaggaaccacaacgaacacacaaaccacgcacagcgaagagacgcacgcaaaagaagagcaagagcaacaaggccacgccgaagaagacacggagcacgcgagaaagcacaaggacgaataccgagagagaaacacgaaacagagccagacacgcagagacaaaacaacgaagccgacgcacaaagaagagaccgagagagagca

SEQ ID NO: 458413 - DNA, 2369 bp, Homo sapiens
ggactctcacgtgaccaggagtcgacgtgtgcagaagtccttatagtccagggcctgtttccctgtagcagctccttattgctggagaaggagaaaagtgcccaagatcctttcaggatatttggttttttgggcgcgacacaaatcgaggtgagggaagagagaggaaaatcccctgaatccctgcaggattaatttattcaaaaaggaaataaaaaatactcaatatgcaaaagtcttgtgaagaaaatgagggaaaaccacagaacatgccaaaggccgaggaagatcgccctttggaggatgtaccacaggaggcagaaggaaatcctcaaccttccgaagaaggcgtaagccaggaagcagaaggaaaccccagaggagggccgaatcagcctggccagggatttaaagaggacacacccgttaggcatttggaccctgaagaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagataaaaaaaaaaaaaaaaaaaaaaaaaaaaaaaaaaaaaaaaaaaaaaaaagaagaaaaaaaaaaaaaaaagaaaaaaagaaaaaaaaaaaagaaaagaaaaaaaaaaaggggggggggggaaaaaataagccaccgcaggaggcacaccaagcaaagacacagaccaagcactacatacaataagaaagaaaagggcggcagcaccaaaggaagagacgacgcgaaaaaataaagaaaacacgagagcgaggaaggcaaataaatacaaacacacagcgagctagaacgagagaaaaaccatagagaggcaaagaagagataattatcatggagagagcgaccaacccaccaccatttgtgagatgggggggagagaaataacataacatgagggtcgaaaacacacactaccacgacggagagagattatattaacagcacgcggaggagcgaggagcaataaataatgcgcacgagaggacagacgcatgatctcaggaaaggtggcagcggaccagcagcctcggtaatagaataatagctgtacgtagcctggctgagagcaagaacaaacgacgtggcagccgaagacgcaagcacggagcacaactaagaacgagacaagaagcaaaacaaaacttaaaaaaccacacagccggcggcgagaataccagcacgacacacaacacaaagcagacgcgcggaagcccgaaaccagaccaccggcagagcaacgccacaagcacagcagcacgaccagacggcagcagacagacagaaagacggaccgacgacccagaagccagcagcgagcgaatgcgtgaaggaggactggacatgcacgtcgagattgagaggggagatggactgacgagaatgaggatgaggatgcaaggaatgcatgtgagagatgttgagaagttaggtatacgttacagactgagggcacgcgacagagcgcgcacacaatacaacagcagcgagagacaccggacgaagagagaccagaacaaggagaccgtcagcgagacgccggagccgcgggcgaccggacccacgaagcgccaccgcaaggcaccagcgcggccaggccaacatagcgcgcaacgagccgagcggagcagagaaaaaaggaaaaaaaaaacagagaagacgaca

SEQ ID NO: 458414 - DNA, 1227 bp, Homo sapiens
tcgcataacggtcgtgaggaactctcacgtgacccgcagtcgcacgtgtgtaaatgtccttgtacttccacggtctgttacgctgatcctggttcctaatagcggtagaatgctaaccgtgcccaagaatcctggcgggatatgagcgttctggagacgctacacaatatcgatggtgaggtcataaatggggtcaatcccctgagatctcctgcaggagttcagttattcattaacggccctaacaatgatactgtgaagaaaatgagggaaaaccacagaacatgccaaaggccgaggaagatcgccctttggaggatgtaccacaggaggcagaaggaaatcctcaaccttccgaagaaggcgtaagccaggaagcagaaggaaaccccagaggagggccgaatcagcctggccagggatttaaagaggacacacccgttaggcatttggaccctgaagaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagata

SEQ ID NO: 458415 - DNA, 3431 bp, Homo sapiens
ggctgcaggctcgcctcggctccatgggcctttcctaatctggttagcgggatgaaggcatcaggtagggtctgtgtggggtggagaggaggagccaggctctggatccagaaccctcttctgcccttgccagctcagcatcccacagaggggtcttcccgctcacagccacagagggttatcagggttatagagaagagtcacctacccagtgcctgtcagggcatcaggtacatcccgggtgctgccacctcacacctgcaatgtccacacggtgaaccgggttgaacagaaggcagcctcgagaggctggagaaaatacaccaagcactgacacagatgaccctgggatgtgggactataggcgatcttcatttttttcttcatacttttcttggtttctaaatcttattcagtgagcacgtgttcctttttttaattagagaaaacttgacagtagcccctttttgtgtttcacagaggagctaacattccttctgtacctgtagttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtgcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttgga

SEQ ID NO: 458416 - DNA, 5954 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgcacaggattcacatctcatttttaccatgctctctgtgccaattagggcagatcttttcactgtcattattaacacatgttgccagccactgggacctgtttgtcctgggggatgccccatgagccctcggatgtttctctccctccaggctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttgggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtgcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttgga

SEQ ID NO: 458417 - DNA, 3252 bp, Homo sapiens
ttggggaggggtgtttaaggggttggctagggtataattgtctgggtcgcctaggaggtcgggtgagatggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtgcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttgga

SEQ ID NO: 458418 - DNA, 5660 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttgggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtgcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttgga

SEQ ID NO: 458419 - DNA, 5991 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttgggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtgcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttggaaaaaaaaaagttttgtgtcaagtcctaagtccaccttcagccaaagggcagttcctggatttgcccctagagaggggggcccagtgttggctgcactcataggctggggcccaggagcacgggttgtggcttaacaaacatgagattcccacaatctcaccacggcataggtgcaccaaaacacaca

SEQ ID NO: 458420 - DNA, 5682 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttgggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctctgtgctgtccggcaactgactagttcccctaataatcggtgcccccgatatggcgtttccccgcataaacaacataagcttctgactcttacc

SEQ ID NO: 458421 - DNA, 1483 bp, Homo sapiens
ctgggctgtcccccagcagccagttcctccaggagacaaagcaagaatttctttcctgtttctcaggccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtgcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttgga

SEQ ID NO: 458422 - DNA, 1440 bp, Homo sapiens
gtaaattagggcttctgcaaaacccagaggcctctccttccagcccctttcccactgtccccgccatgccagtgcccacctgagggaactgtccaggggttgggtgccttatctcacacaccccaccagacagctcagcctcatgctcagcccagggcctggtggtcccagcagcctgagtccagcccccggtggtcagaaaggaaggccttccagactcttgctcggctgtggtctccccacctcactccatctctgggtgcttggcttttgccctgcatgagccagaagagctgctggggtgcaaggacgccaactgaccgcatcctgcgcctcccggcttcccaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtgcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttgga

SEQ ID NO: 458423 - DNA, 4308 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttgggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaaggtaagcctgcacctgcatggccgtcctcttcactcacagagtgtgttccacaccagcttgtgcccggtctgtccccagccctcacaggctcctcagagcctcctcaggggcagggctgcccagcagtccccttgctccccctaccccaggccctgtgattgtcccttgatac

SEQ ID NO: 458424 - DNA, 3482 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttgggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacgtagcgagttccaggtaggcgggatactctagataagcca

SEQ ID NO: 458425 - DNA, 2968 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttgggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccggtaggaccctgacctcgggttggcagtgaggatgggatgggataacagacgggaagagccttccctggtgccgccaccaccaagca

SEQ ID NO: 458426 - DNA, 2334 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgaggtacacgtgccttcaccaccatgcacatgcacatccacatttgagcagggttttcatttttgtgccctcgtaagcatgagacttttttcaacttctcccaagacatgcaaactttctgaaaaaccaagcaaaaacaccctctacttttctcgtatgcccctccttcatgaccaccagacaccacgtatagtaacacctcccagtatctaagctccgcatcatcttctctctgataggaaacaggcttctgagcagttgcagtcagtgttgtgaactcagcccacggactgagcgaggcccttctgaggacccagcctcgctgagtgcgtgtctaggacactcactgagctgtttcccaggaccatggttgagtacaaacagcaaatgcgacatggggtggggccggctccaaaacagtcctgcatgtggcccgatgctcaggacacatctgtggccacagcagtcctgtggcagtacggtagtgac

SEQ ID NO: 458427 - DNA, 1300 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatgtaagggaggccagagccagaacaccactaaccctgtgcaagctacgttaaactcttgactataagggatgtacaaatacagattaaatataccttgcagatgagctaaatgctgacaacggttttaatgcggagtagtaagaatagtgtaagatg

SEQ ID NO: 458428 - DNA, 1228 bp, Homo sapiens
gtaaattagggcttctgcaaaacccagaggcctctccttccagcccctttcccactgtccccgccatgccagtgcccacctgagggaactgtccaggggttgggtgccttatctcacacaccccaccagacagctcagcctcatgctcagcccagggcctggtggtcccagcagcctgagtccagcccccggtggtcagaaaggaaggccttccagactcttgctcggctgtggtctccccacctcactccatctctgggtgcttggcttttgccctgcatgagccagaagagctgctggggtgcaaggacgccaactgaccgcatcctgcgcctcccggcttcccaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcggtcagccagccacagcgccaccctcctctcccttcacccctggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctagggcgagagccgccattgctctgagtcagaagctggagctgggcggagtggggctggtccaggttcagtgccccagcttggctccttcctccacttcctcccttctctttctctgcctgctgccccaccacccaccccatcactgtctccaagaaaacacaacctgcctgttgggggtggagggggtgctcaaagttacaggatcctgcatatgctaatacagtccaagatgcctagttctaaggctcattcttgcgctgtaacactgagagtatccttatgaggcctgattgtctgtacattggtatttaagctctatggaacatgcagca

SEQ ID NO: 458429 - DNA, 448 bp, Homo sapiens
aggcgacgagagaaagaaggcttgtctgtcggccctgtctgaagtgaaggtgcagccgggtgagcaggtggcttctggaggctcagaccaacctcttcctgcaggcgggcggcggggcgtgaaggctgctgccctctccaggcactgcaggatgtggacacagtggcttggccagccccacacctgcttgggcccacggtgcctggtgccccaggaccccagcccctccccagaatctgccgctagtgagcgggagctgctcgtcagtgggtgcccttcatcttccttgctgcctgctgtttttctggaggctgacagtgacctcagtagctgttactctagaagagggttcctaggctccagcattacaggagcaggtcacacagacgaggggatggcgggcccagtgtgggacggctcaggtgtgctgggacccatcagcaccacc

SEQ ID NO: 458430 - DNA, 428 bp, Homo sapiens
ccaccctcctctcccttcacccctggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctagggcgagagccgccattgctctgagtcagaagctggagctgggcggagtggggctggtccaggttcagtgccccagcttggctccttcctccacttcctcccttctctttctctgcctgctgccccaccacccaccccatcactgtctccaagaaaacacaacctgcctgttgggggtggagggggtgctcctgttgcagtccttttccactcctcaaaacagaccacttgtccttgcccgccctggct

SEQ ID NO: 458431 - DNA, 695 bp, Homo sapiens
ttgatttgggtgtgccatgaatagatgaagaccttccaagcagggcagctgggtgtgttgaagtcatagtctgaagttgttaatgacaggttgaagataccacttgtcagcccttggggtggaccccattattgtggcttattttgaaccttcacagttattagtgggtgggttgtgaaatcttagtcaatgttacaagttagtacttactatatgactctatcaggatactttcttatattgtaacgttttcacttgatcttctagaatacctttgcaagtatgctatcccatgcctgataggaatctcgcgagcatttgggcgttacagcaacatggaagagtctctcctctcaaagctctttcccaaaatccctcctcattccctccgtgtcctggaagagcttgaaggtgttcgaaggcgttcctttaatgacttccgctccatcctccccagcaatctgctgactgtctgtcaggagggtaccctgaagaggaaaaccagcagtgtgtccagcatctctcaggtgggcctgggctactggggaaagagcagaggagaaagaccctgttaagctcccctgcgaagaaaatccctcttctttgtagttggagtaaacttaagtaacgtgaaatgtttcactagaattctctttaatacaaagacttgtcttgtccctcttaagatgttgggg

SEQ ID NO: 458432 - DNA, 454 bp, Homo sapiens
ttgcaaaggcctatttaccagtagcagaaactgccttccagagacttttttttttaatttcttatggaacatatcaaactgctgggtattctaaaatattttgctttattaacttgccagcagtgaagatttttattaatagtaacccccagacccgagtgtgactgcttcattgggtttaggcttagccatggtaaacacgaggaaaggatagtgctgccatagtctacaataatggttatctgtctgtaggcaactcagctgagcgagcgcccggcctgtgtgaagaaagactactccaacttcatggcatccctgaatctgcgcaaccgctacgcgggcgaggtgcttctcttgtccttgcgccctagggcctttaacgtgtcctcttgttttgaggcctgttggccgcttcctagtggaaaatgaacaaagcgtcccggtgatgtggaat

SEQ ID NO: 458433 - DNA, 409 bp, Homo sapiens
attgtgcgtatgcatgcctctgtccttatctccttgtctcagagcataggcatgtatcagggttgtcacaagatttaaggtgaagcccaccttggattgtacttcctggaccactgtgtggaagtcgagaaagatctttgtcatccagactagtgcctggggcttatgtttctgcccgtggttaaaatcctgggctgtcagtttcagatgaacactgcatcaagactgttatgaaattaaggtctagatcgtagtctctgggtactgtttcactactgcatgctggagggactgttgctaaggcgcttctgttcttccttctgtagggacgctcacttgattcccgaccacacaatccgagccttgggacacattgcggtggccttgagggacaccccgaaggtcatgg

SEQ ID NO: 458434 - DNA, 344 bp, Homo sapiens
ggtttgggccgcctgtgcgagaggttcccggtggtggtgcactctgtgacaccgtccttgcgagacttcctggtcatcccgtccccagttctggtgaagctctacaagtaccacagtcagtaccacacaggtaataacagactatgtgcccttcaggccctgagaaaggggctctgtgactgtgtgtgagcctcacacaggtttcatgactgtacctgggtgcattccttcgccacacctttccttctgtctttccctttgcgtcccctccaagctccaggcctttcttccccggccttctctcatcctgtattcctgttacaccaaaggccccttcaagtcct

SEQ ID NO: 458435 - DNA, 6493 bp, Homo sapiens
  misc_feature (6)..(6): n is a, c, g, or t
  misc_feature (12)..(12): n is a, c, g, or t
  misc_feature (18)..(18): n is a, c, g, or t
atgtgnccagtngatttncatgggatcttccagttagatgaaagacggagagatgcagtgattgcattgggcatttttctgattgaatctgatcttcagcacaaagattgtgtggttccttaccttcttcgacttctcaaaggtcttccaaaagtgtattgggtagaagaaagcacagctcggaaaggcagaggtgccctcccggttgcagagagcttcagcttctgcttggtaactctgctgtctgatgtggcctatagggatccttcacttagggatgagattttagaggtgcttttgcaggttttgcatgtcctcttggggatgtgccaggccttggagattcaagacaaagaatacctttgcaagtatgctatcccatgcctgataggaatctcgcgagcatttgggcgttacagcaacatggaagagtctctcctctcaaagctctttcccaaaatccctcctcattccctccgtgtcctggaagagcttgaaggtgttcgaaggcgttcctttaatgacttccgctccatcctccccagcaatctgctgactgtctgtcaggagggtaccctgaagaggaaaaccagcagtgtgtccagcatctctcaggtcagccctgaacgcggcatgccccctcccagttcccctggaggatctgcctttcactactttgaagcctcctgtttgcccgatgggactgccctagagcctgagtactacttttcaaccatcagctccagcttctcagtctctccccttttcaacggtgtcacatataaggagtttaacattccattggaaatgcttcgggaactcttaaacctggtgaagaagatcgttgaggaggctgttctcaaatctttggatgccattgtagccagtgtgatggaggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttgggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtgcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttgga

SEQ ID NO: 458436 - DNA, 5804 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttgggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtgcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttgga

SEQ ID NO: 458437 - DNA, 6504 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttgggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggtgagcctgggtgagggccagggtggaggcggagggggtgtgtggaacgttctgagatcccctttaggatgaagggaatccggttccagagagtgaggtaggtgctagcagccacctgctgacctacacctgtcctttggtcacctctgtctgcccacctgtgccagtaaattcttgctctggacatctaattccaaccaccttccccacgatcctgcccacgccttcagccatgggctctccctttctgggcatcccatccaccctgtcaccaaagcctgagcacctgccaccccacaggctacgtgccaaagatgggctttgtcccagtttcatatacaggtcacttggccaaggcacagtccaacctgggttcatccccactgccctgcagagaaaggcaggtcagcgtgtctgcatcccacccaagtgcagaagccatggccggcagccttatgtgggggacagggcaggacactcagcctgtccagagtgcgtgtgggcagcccttgcctgggcggtatgggttaccaagtgcagcagatcgaaagttgcctcggggatgtgcaagatgtggcaggcgaggtgggtggcaggagcccacacctgaggctgttggcatcagccaggccacaggactacaggcagggccaccacctaggctggcctcagcccaccgctccctcctatctctccccaggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtgcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttgga

SEQ ID NO: 458438 - DNA, 3546 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgactgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtgcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttgga

SEQ ID NO: 458439 - DNA, 5811 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttgggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcgactttggcttcatgtttgaaagctcgccgggcggcaatctcggctgggaacccgacatcaagctgacggatgagatggtgatgatcatggggggcaagatggaggccacacccttcaagtggttcatggagatgtgtgtccgaggctacctggctgtgcggccctacatggacgcggtcgtctccctggtcactctcatgttggacacgggcctgccctgttttcgcggccagacaatcaagctcttgaagcacaggtttagccccaacatgactgagcgcgaggctgcaaatttcatcatgaaggtcatccagagctgcttcctcagcaacaggagccggacctacgacatgatccagtactatcagaatgacatcccctactgaggaggggaccttcgagggcctctgccccatgtgccctcaaagctgtcccacaatcatggagccctgcgacctccctgccctgccgccacatgcagtggaggagaggcctgtggcccaaagaacctggtagcgcctcctggggcagcacgtgggtgcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagatataatctaacgcacattccaacaatactctttcttcttggttgtgctgtttgtggtttt

SEQ ID NO: 458440 - DNA, 5592 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttgggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaagccctaccctaaaggcgacgagagaaagaaggcttgtctgtcggccctgtctgaagtgaaggtgcagccgggctgctacctgcccagcaaccctgaggccattgtgctggacatcgactacaagtctgggaccccgatgcagagtgctgcaaaagccccatatctggccaagttcaaggtgaagcgatgtggagttagtgaacttgaaaaagaaggtctgcggtgccgctcagactccgaggatgagtgcagcacgcaggaggccgacggccagaagatctcctggcaggcagccatcttcaaggtgggagacgactgccggcaggacatgctggccctgcagatcatcgacctcttcaagaacatcttccagctggtcggcctggacctctttgtttttccctaccgcgtggtggccactgcccctgggtgcggggtgatcgagtgcatccccgactgcacctcccgggaccagctgggccgccagacagacttcggcatgtacgactacttcacacgccagtacggggatgagtccactctggccttccagcaggcccgctacaacttcatccgaagcatggccgcctacagcctcctgctgttcctgctgcagatcaaggacagacacaacggcaacattatgctggacaagaagggtcatatcatccacatcggtcagccagccacagcgccaccctcctctcccttcacccctggcacccaggggtggatagggatccccaccccacagagaggagaatgcccaggaccaccctgccaggagtgtcagggtccagctctgaggtccgaactgtcggccaccaagctgttctgctgtagagggtgcctggccccggccccagggagctagggcgagagccgccattgctctgagtcagaagctggagctgggcggagtggggctggtccaggttcagtgccccagcttggctccttcctccacttcctcccttctctttctctgcctgctgccccaccacccaccccatcactgtctccaagaaaacacaacctgcctgttgggggtggagggggtgctcaaagttacaggatcctgcatatgctaatacagtccaagatgcctagttctaaggctcattcttgcgctgtaacactgagagtatccttatgaggcctgattgtctgtacattggtatttaagctctatggaacatgcagca

SEQ ID NO: 458441 - DNA, 4680 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttgggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaagttcctggtcacctggcacaccatcgacgccgatgctccagagctcagccatgtgctgtgctgggcgcccacggacccacccacaggcctctcctacttctccagcatgtacccgccgcaccctctcacggcgcagtacggggtgaaagtcctgcggtccttccctccggacgccatcctcttctacatcccccagattgtgcaggccctcaggtacgacaagatgggctatgtgcgggagtatattctgtgggcagcgtctaaatcccagcttctggcacaccagttcatctggaacatgaagactaacatttatctagatgaagagggccaccagaaagaccctgacatcggcgacctcctggatcagttggtagaggagatcacaggctccttgtccggcccagcgaaggacttttaccagcgggagtttgatttctttaacaagatcaccaacgtgtcggctatcatcaaccctgcgacctccctgccctgccgccacatgcagtggaggagaggcctgtggcccaaagaacctggtagcgcctcctggggcagcacgtgggtgcgcagccttggtaacgccatggactgcagcgacaatcaatggatggtgctgtctatgcacaggtgtgagtcctctgtttgcactggacatattccctacctgtcttatttcataggtacatgaagtattgtgtataaaaaaagagataagatttaaccaacatcaacaaaataaaaacccaaaatagtgctgtgttgga

SEQ ID NO: 458442 - DNA, 4119 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctgggatgatgcagtgtgtgattgcagtcgcggacaaagtattcgatgccttcctgaacatgatggcggataaagccaagaccaaggagaacgaggaggagctggagcggcacgctcagttcctgttggtgaacttcaaccacatccacaagaggataaggagggtggcagacaagtatctatctggtctggtggataagtttccccacttgctctggagcgggactgtgctgaagaccatgctggacatcctgcagaccctgtcactgtcactgagcgctgatattcacaaggatcagccttactatgacatccccgacgccccctaccggatcacggttcctgacacgtacgaagcccgtgagagcattgtgaaggacttcgctgcacgctgtgggatgatcctccaggaggccatgaagtgggcacctaccgtcaccaagtcccacctgcaggaatatctgaacaaacatcagaactgggtatcgggactgtcccagcacacggggctggccatggccactgagagcatccttcactttgctggctacaacaagcagaacacaactcttgggggcaactcagctgagcgagcgcccggcctgtgtgaagaaagactactccaacttcatggcatccctgaatctgcgcaaccgctacgcgggcgaggtgtatggaatgattcggttctcaggcaccacaggccagatgtctgacctgaacaaaatgatggtccaggatctacattcagctttagaccgcagtcatcctcagcactacacgcaggccatgttcaagctgaccgcaatgctcattagcagtaaagattgtgacccgcagctccttcatcatctgtgctggggtcccctccggatgttcaatgagcatggcatggagacggccctggcctgctgggagtggctgctggctggcaaggatggagtggaagtgccgttcatgcgggagatggcaggggcctggcacatgacggtggagcagaaatttggcctgttttctgctgagataaaggaagcagaccccctggctgcctcggaagcaagtcaacccaaaccctgtccccccgaagtgaccccccactacatctggatcgacttcctggtgcagcggtttgagatcgccaagtactgcagctctgaccaagtggagatcttctccagcctgctgcagcgctccatgtccctgaacatcggcggggccaaggggagcatgaaccggcacgtggcggccatcgggccccgcttcaagctgctgaccctggggctgtccctcctgcatgccgatgtggttccaaatgcaaccatccgcaatgtgcttcgcgagaagatctactccactgcctttgactacttcagctgtcccccaaagttccctactcaaggagagaagcggctgcgtgaagacataagcatcatgattaaattttggaccgccatgttctcagataagaagtacctgaccgccagccagcttgttcccccagataatcaggacacccggagcaacctggacataactgtcggctctcggcaacaagccacccaaggctggatcaacacataccccctgtccagcggcatgtccaccatctccaagaaatcaggcatgtctaagaaaaccaaccggggctcccagctgcacaaatactacatgaagcgcaggacgctgctgctgtccctgctggccactgagatcgagcgtctcatcacatggtacaacccgctgtcagccccggaactggaactagaccaggccggagagaacagcgtggccaactggagatctaagtacatcagcctgagtgagaagcagtggaaggacaacgtgaacctcgcctggagcatctctccctacctagccgtgcagctgcctgccaggtttaagaacacagaagccattgggaacgaagtgacccgtctcgttcggttggacccgggagccgttagtgatgtgcctgaagcaatcaaggtagtgtagcccacgtaccagggcctgagttcaaactgcacaaaatagcacactgcacccagaaatgcctgaaactagaaatgagacaaaaacagccgcttggcaacttcagtgctattcatggtttttctgatttcctgtgttttctatttcttgtctgtagcatttattttgttcacagtagaaaaaaatgtaatgcacttca

SEQ ID NO: 458443 - DNA, 2484 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgcacaggattcacatctcatttttaccatgctctctgtgccaattagggcagatcttttcactgtcattattaacacatgttgccagccactgggacctgtttgtcctgggggatgccccatgagccctcggatgtttctctccctccaggctgagctgagtgagctccgcagcactatcatcaacctgctggacccccctcccgaggtgtccgcactcatcaacaagctggacttcgccatgtccacctacctcctctctgtgtaccggctggagtacatgaggtacacgtgccttcaccaccatgcacatgcacatccacatttgagcagggttttcatttttgtgccctcgtaagcatgagacttttttcaacttctcccaagacatgcaaactttctgaaaaaccaagcaaaaacaccctctacttttctcgtatgcccctccttcatgaccaccagacaccacgtatagtaacacctcccagtatctaagctccgcatcatcttctctctgataggaaacaggcttctgagcagttgcagtcagtgttgtgaactcagcccacggactgagcgaggcccttctgaggacccagcctcgctgagtgcgtgtctaggacactcactgagctgtttcccaggaccatggttgagtacaaacagcaaatgcgacatggggtggggccggctccaaaacagtcctgcatgtggcccgatgctcaggacacatctgtggccacagcagtcctgtggcagtacggtagtgac

SEQ ID NO: 458444 - DNA, 2544 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggcattgctccctggcagtgattaatgccctggccaacatcgcggccaacatccaagacgagcacctggtggatgagctgctcatgaacctgttggagttgtttgtgcagctggggctggaggggaagcgagccagcgagagggcaagcgagaagggccctgccctaaaggcttctagcagtgcagggaacttgggagtactcattcctgtaatagctgtgctcacccgacgactgccacccatcaaagaagctaagcctcggttacagaagctcttccgagacttctggctgtattccgttctgatgggattcgctgtggagggctcaggactctggccagaagaatggtacgagggggtctgtgaaatagccactaagtcccccttgctcacctttcccagcaaggagccactgcggtccgtcctccagtataactcagccatgaagaatgacacggtcacccccgctgagctgagtgagctccgcagcactatcatcaacctgctggacccccctcccgaggtgtccgcactcatcaacaagctggacttcgccatgtccacctacctcctctctgtgtaccggctggagtacatgagggtactgcgttcaacagatcctgatcgcttccaggtaatgttctgctactttgaggataaagctattcagaaagacaaatctggagagagactaagcaacaacaaaattgaaactgccaacctctagaagaattaagcacctagcacattattcagacaagacctgaggagacaaaaaaaggaagaaaaaggctgggtgcggtagctcacgcctgtaatcccagcactctgggaggctgaagtgggtggatcacttgatgtcaggagttcgagaccagcctggccaacatgatgaaaccccatctctactaaaaatacaaaaattagccaggtgcggtggcgtgtgcctgtagtcctggctacttgggaggccaaggcaggagaatcacttgaacctgggaggcagaggttgcagtgagctgagatcacaccacacactccagcctgggagacagagtgaaactccatctcaaaaaaaaaaaggaaggagaacctagcagattttgccagccttctagagaatattcataaaccgaatcagatccctttctgaagtgagatgtctcattcgcccttctctctgagctctgtttttctgttcctgtgacatcagaggacgttaaattgttccgggggactgattgttcctcctcaccttaattcaaaataaagcgattttcatttttgcagtacatt

SEQ ID NO: 458445 - DNA, 1354 bp, Homo sapiens
cgagctcggtacccctaatttcttttgaaacagatggtccacatccttgaaagagttcttcatatagacttcagtggcctccctctcactaaccctgtgcaggtccagcagctcctggagggtttctgcgggcagctgcaccttctggcccatctgctggtcatagtgggcaatagccttttgcactgcggctgagttctctatctgggccaaccccagtgctgatctctactacacttccttcagtgaccctctctacctgaccatgttcaagatgctgcgtgacactctgtactacatgcatcaggacctcccgacctcttttgtgaaggagatccatgattttgtgctggagcagttcaacacgagccagggggagctccagaagattctacatgacgcagaccggatccacaatgagctgagccccctcaaactgcgctgtcaggcgaatgctgcctgtgtggacctcatggtgtgggctgtgaaggacgagcagggtgcagaaaacctttgcatcaagctatctgagaagctgcagtccaagacgtccagcaaagtcattattgctcacttgcccctgctgatctgctgtctgcagggtttgggccgcctgtgcgagaggttcccggtggtggtgcactctgtgacaccgtccttgcgagacttcctggtcatcccgtccccagttctggtgaagctctacaagtaccacagtcagtaccacacagttgctggcaatgatataaaaatcagtgtgaccaatgagcattccgagtcaaccctgaacgtcatgtcgggtaagaagagccagccctccatgtacgagcagctccgagacatcgctattgacaacatctgcaggtgcctgaaggctggattgacggtggacccagtgattgtggaggcgttcttggccagcctgtccaaccggctctacatctctcaggagagcgacaaggacgctcacttgattcccgaccacacaatccgagccttgggacacattgcggtggccttgagggacaccccgaaggtcatggagcccattctgcagatcctacagcagaaattctgccagccaccctcccccctcgatgtgctgattattgaccagctgggctgcctggttatcaccggaaatcaatacatctatcaggaagtgtggaacctcttccagcagatcagtgtgaaggccagctccgttgtatactcagccaccaaagattacaaggaccacggctataggtaactggacctcattgtcacttttttatcatgacagtatttaacttactttaaaaatgtgaggtttgtgaatttgtctcttaaataaactcttcttgcaagaaaa

SEQ ID NO: 458446 - DNA, 571 bp, Homo sapiens
gatctaagtacatcagcctgagtgagaagcagtggaaggacaacgtgaacctcgcctggagcatctctccctacctagccgtgcagctgcctgccaggtgggcccccgggcaccacagcctgacacaggcctcaccagaggtccagcgcagggtgcttgccagctgggtcatgagttctcaggagtgccctgcagcccctttcaaggatagtcaggaagtagtctagtcctcgagccccaggacactccccgagcccttctgtgcagagataacccagcaaccctcgtgatcttttcagatgcctgcctggggtgctgcagcagctggagcctagggaggtagcagcagggtgaattcagagccaagatctgattcctgccggataggaagcatgtggaggctgtcactcctggcaggtggctgccggaaccgccttggggagggtttgggtttgttcctggatgtcacctttcagtggcagagtatttggaggaggcacatgctgcagacagcagtgacattcctgtgatctctctgtggcagctcttatggggacagaacttcagaccg

SEQ ID NO: 458447 - DNA, 4948 bp, Homo sapiens
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatata

SEQ ID NO: 458448 - DNA, 2128 bp, Homo sapiens
tttttttgcccccgagacagagtcttactctgttgcccaggctggagtgcagtggcacgatcctggttcactgcaccctctgcctcccaggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgta

SEQ ID NO: 458449 - DNA, 246 bp, Homo sapiens
  misc_feature (27)..(27): n is a, c, g, or t
ccaaaaaaaaaaaaaaaaaaaaagccnaaaggaaaaaaatataatttttaattattttaggtgattttaagcagcctgggcagcatggcaagacctagtctctataaaaaattggctcatgcgtctggtcccagctgcttgggaggcaaaggtgagaggatcacaggaggttgaggctgaagtgagccatgttcatgacactgcactgtagcctgggcaacagagtaagagcctctgtccaaaaaa

SEQ ID NO: 458450 - DNA, 4047 bp, Homo sapiens
  misc_feature (68)..(68): n is a, c, g, or t
tagctgactagcagttactgatataagcacgctggcatggaggaacggtcatatgctaataacggagnccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatata

SEQ ID NO: 458451 - DNA, 6110 bp, Homo sapiens
  misc_feature (1262)..(1262): n is a, c, g, or t
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtgagtataatacttttacaaagttactttcattcattactcccaaatgtgattattaataaaatagtattctaaagagttncatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatata

SEQ ID NO: 458452 - DNA, 5735 bp, Homo sapiens
  misc_feature (1262)..(1262): n is a, c, g, or t
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtgagtataatacttttacaaagttactttcattcattactcccaaatgtgattattaataaaatagtattctaaagagttncatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgta

SEQ ID NO: 458453 - DNA, 5904 bp, Homo sapiens
  misc_feature (1262)..(1262): n is a, c, g, or t
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtgagtataatacttttacaaagttactttcattcattactcccaaatgtgattattaataaaatagtattctaaagagttncatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgtaaaaaaaaaccacaaaacgaacactttttgggccctgggcccgaaaatttcaaaccacgtggggcggggccaagggtaggacacgggccacggccccagaaccggccgcaagggggtctccaaaaagccgggacccggtcaaaccagggcgggccggccacgcccgggta

SEQ ID NO: 458454 - DNA, 4434 bp, Homo sapiens
  misc_feature (1262)..(1262): n is a, c, g, or t
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtgagtataatacttttacaaagttactttcattcattactcccaaatgtgattattaataaaatagtattctaaagagttncatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaac

SEQ ID NO: 458455 - DNA, 4488 bp, Homo sapiens
  misc_feature (1262)..(1262): n is a, c, g, or t
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtgagtataatacttttacaaagttactttcattcattactcccaaatgtgattattaataaaatagtattctaaagagttncatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgt

SEQ ID NO: 458456 - DNA, 2149 bp, Homo sapiens
ctgttgcgaggaatgctgagacaagcatatgctactggcaggatcaaccaggtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatata

SEQ ID NO: 458457 - DNA, 3280 bp, Homo sapiens
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccagggtaatggctgcttgtgtgtcctcactcttcagcactgcaaatctgttctcaacttgcattgaggaaaagggctggcgttttcaaatttttaatgttgtgaagttctatttctaacttatttttactttattttggcaaactggcatttatggatgtacatatgcataaatatgtttttttctatgaaacagggcatgttttgtgttttaaaatcctttttacacaggccttttttttttttttgggagactgagtctcgctctgtcgcccaggctggagtgcagtggcgctatctcggctcactgcaagctccgcctcctgggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacatcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgta

SEQ ID NO: 458458 - DNA, 4218 bp, Homo sapiens
  misc_feature (1262)..(1262): n is a, c, g, or t
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtgagtataatacttttacaaagttactttcattcattactcccaaatgtgattattaataaaatagtattctaaagagttncatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccacacgtgcacccatccacatgctcaaacacctgggcacacatgcacacacacacaccctcacactcgcc

SEQ ID NO: 458459 - DNA, 5311 bp, Homo sapiens
  misc_feature (1262)..(1262): n is a, c, g, or t
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtgagtataatacttttacaaagttactttcattcattactcccaaatgtgattattaataaaatagtattctaaagagttncatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtacgtaatgctggttgtggagccttgaaggagcacttttattaacattggacattctctttacccctagtaaaaaggatgtctcactccatatgctttatttgtaaatgtgaatccagctaagacaatgatttcaaaataccacttttcttagatttgactattctgggtaagattagaggatcataaagctctttgatacagttcttttctctaccagaagataaaacttgaaatttacatgctgtacaaaataggcaggatcagatttccttcaggttgtcttcttctgactagaagtgctgtgatcatataaaattaagtaacagtgttgttgtatttaagttttaaagaaatattctttggcataaaagatccaaagaggagatgctaatgggcaacacgtttatactgaaatacactgtcttgttgattgtgtagtgaagactcctcatagctccttaaacccaacatattttcaaaattataagcagagacttttccttcccaaatctttttcttctccagaattccgtctctcagcagcaaacattatcatccaacaaattgcataagtcagaaaccttgaaggctatccatgtcaccttattctgtcctccatgtccctctggtctccaagtgtcccattcttccctgaagaatctggtctctcgtctctggagcctttgctcctgacttttgttgagtcattcgtctcctaccctaactttggcaccttcctatctggtttcccagccttgaacctgccatcactaattccttctccacactgggcacaatgacctttcaaaagaatgaatctcattgtacctctttggtgaacatttttttcattggttcctctgtggcctttaatgcagtccaaccttttggcatagtttacaaggctcctccttttgctttgatgtgggcttcagtttgacctcactccatgtcatatactctgagttttgattaaacaaccatggaatggcctcttatcaaacacacaatgtcctctccataactgtctccacattttcatttgtcttatccatctgccagaaatgaccccgtcctccctttaaccgtgagagaggagcttaaaaaaaacacacaaccaaacttgcagtgtaacatgtatacttgtatgttaccttactaggtcaagaaatagaacttttccagccctttggaagccctttgtgtgtgtgcccttctttaccttttgccactggtttgacttctaatagtctcattgcttcttagacagtaaagatattagccatgtgcagtagctacttgggaggctgaggtgggaggttgcttgaagccaggaattgaagaccagtctgagcaacatggcgagacccaacctcta

SEQ ID NO: 458460 - DNA, 3680 bp, Homo sapiens
  misc_feature (1262)..(1262): n is a, c, g, or t
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtgagtataatacttttacaaagttactttcattcattactcccaaatgtgattattaataaaatagtattctaaagagttncatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgggagtggccctttccttttggggtcccgtttagcttggcatggggtttccctgaggtttccttggatagaattcccttttttttcagggagggatggggccttgagca

SEQ ID NO: 458461 - DNA, 899 bp, Homo sapiens
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgggcatcagggttttcccctcatcactgcgttctcagctggtgggttagcaggctgatcgtcgacgc

SEQ ID NO: 458462 - DNA, 1073 bp, Homo sapiens
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgtgagtattcatgcctctgattggagttatttaaacattgcataactacttaatattataaagcaatattgcatcatattattatttgactgatgtttagttatttgatgtcagagtgtcatgtattaggaaagccttacttagaagatgttcatcggaactaagaatgagtttaacaggtcagttttttgagtgaatgtgggaaagaacacagcatacagaatggctaaccatgaaagttcatgaaagcgttgaaaaaatcaaatcaaatcataattagatatgaagtatgctagagctttcaagggctacaaaagacggccgggcgcggtggcttatgcctgtaatcccagcacttcaggaggccgaggcaggcggatcacgaggtcaggagtttgagactagcctggccaacatggagactgaggcaggagaattgcttaaacccaggaggcggaggttgcagtgaactgagatcgcaccactgcactccagcttgggcaacagagcaagactttgtctcgcaaaaaa

SEQ ID NO: 458463 - DNA, 456 bp, Homo sapiens
atcatgaagactttgatagttgcggtgctgttggctggagttgtccctctccttctggggctcctgtttgagctggtcattgtggctcccctgagggttcccttggatcagactcctcttttttatccatggcaggtaaatgtatgtcttttgctcatgttatttcattaaggatttgagatcagaaaataatcctagccaggcatggggcttacgcctataatctagcactttgggaggctgaggtgggaggactgcttgcacccaggagttcgagaccagcctgggcagcatggcaagacctagtctctataaaaaattggctcatgcgtctggtcccagctgcttgggaggcaaaggtgagaggatcacaggaggttgaggctgaagtgagccatgttcatgacactgcactgtagcctgggcaacagagtaagagcctctgtccaaaaaaaa

SEQ ID NO: 458464 - DNA, 483 bp, Homo sapiens
acttaccttgttttggttgtgatttcatcaaattgtgtactctttagacattgtgatttttgtcttttgtttttttgatgaagacattgatatatcgaatgtgatatctttttcctaatgtgaaaatactaacataacaacatgaagatgacaattctctttacctagccacatgtctcatttatcagcttttctattttcagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgtctcatggtatgtgtgtgtaatacaagactgatcttgtatgttaggaatagtgaatatttttccagtcatcttaaatttttttttttggcacatttat

SEQ ID NO: 458465 - DNA, 6164 bp, Homo sapiens
  misc_feature (1262)..(1262): n is a, c, g, or t
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtgagtataatacttttacaaagttactttcattcattactcccaaatgtgattattaataaaatagtattctaaagagttncatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatata

SEQ ID NO: 458466 - DNA, 4225 bp, Homo sapiens
cccgcctatttacaaatatctcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatata

SEQ ID NO: 458467 - DNA, 6110 bp, Homo sapiens
  misc_feature (1262)..(1262): n is a, c, g, or t
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtgagtataatacttttacaaagttactttcattcattactcccaaatgtgattattaataaaatagtattctaaagagttncatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtaagaaaacatgaactttatgcttcactgttagttgtttgtggaagttattttgtataacaccaaagctgttgtacatttcctactgcctgatttttttcatgtgtctgtgtttgtaatattgtatagtatcttgtgctaggtgaggaaattatttttaattttgataatttaatattcctagtgtgatcagcattgggagttgggtttcagtggggcatgtctatacttagagaaaaaaagtccaaatgaagattttcatgagtcagcccccccgcccgcccccaccccacacccacatcctctcttttccacacacaactatctgtttattttttgtagcagtggccgaaagtcctgcaaggtcataaatctttcagagtgacatcaccaactgtactgcatcttactggatttaggacttctgagatgcttgtgaagtatagatgtggttgtggtcttagattgacagcattagagaagactggttagaacatctggtctcgctggttagtgcctcgttggctgaggactaggtgtgcatttctcctagcttttcatcaggaaatcccaaagtttccaaagctttttgtttacagaataaaacttcaaataaaaccaattcattatttgtccagaaggaagcttggctgagctggccttttaacataggaatgtatttcgttggaaacattctgaaaaatctcagagaactgaacccttacaaactttgttttccctcataaccaaagcttcaggttagaagtttagaaaaatagaatggttgggtacatgatctaaatgtttaatgctaaaggtatatcgtaagggtagtgtttgtttttgaacgataatttagaagttctcatagaaagcgtataacataggtcttcagaaactataaaagaattttcatatagtattaaaatccatagactaaaatctgagaattttttaacatatgcaagtcagccaaacataagctaccaaaataaagagcaatgtgttctggctgttttatacttcaacaattttttccctaagtggtaagcaattactttaaaacatatttttaaaaacatcggtatcgggagctgcggtggctccggccggttgtcctggcacacaaggaggcgaggctatgcgttcgaggccaacctaggcaaaattggaaaaaaaaaaaaaaatcagtatcagaaataatgcttgacataggattcagtgttatactctttggcactttagagcagccttttctctcatttgaaataaggtctttgttagccctacctttactcagaaatttagtcctactataaaaaattaggattttaaaatataatgctgcctgtcatagtgtatttctaaattgctctctttgggagaaaaacattattattgaattgagcatataactatataactatataactatatatatatatatatatatatatatatatatatatatatatatatatata

SEQ ID NO: 458468 - DNA, 3334 bp, Homo sapiens
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccagggtaatggctgcttgtgtgtcctcactcttcagcactgcaaatctgttctcaacttgcattgaggaaaagggctggcgttttcaaatttttaatgttgtgaagttctatttctaacttatttttactttattttggcaaactggcatttatggatgtacatatgcataaatatgtttttttctatgaaacagggcatgttttgtgttttaaaatcctttttacacaggccttttttttttttttgggagactgagtctcgctctgtcgcccaggctggagtgcagtggcgctatctcggctcactgcaagctccgcctcctgggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgta

SEQ ID NO: 458469 - DNA, 3045 bp, Homo sapiens
  misc_feature (309)..(309): n is a, c, g, or t
cggacgagcgaagagctggtgaagagcgtagtagaagggtagcgccctagatccgagtgagacgagagggagtgcgccagataaggggccccgggcacgatgctgggcccaccaaatctatgagggaggccaagagccccctaaaaggcccctacgtgagcccgtcttaaaggccttggaagggcaccccagccttgaggcggtttcttgtttaagggcgttcggcctgtgaaataggcgtttccaattgacccgtttttccaaatttggcgcaattcccatgccataggggcgcactgtggaaagccntcgtagggcctttcgtttcgccatcgggcaaagggattttctcaggcgattagtgggtaccccgggttttcaatcagacgtttaaacgcggcaagttttttttttttttagcaggaataatgtgatttggaaacagagcaaaacagacaagtggatctaaatttctgggcttttctgtgattttaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccagggtaatggctgcttgtgtgtcctcactcttcagcactgcaaatctgttctcaacttgcattgaggaaaagggctggcgttttcaaatttttaatgttgtgaagttctatttctaacttatttttactttattttggcaaactggcatttatggatgtacatatgcataaatatgtttttttctatgaaacagggcatgttttgtgttttaaaatcctttttacacaggccttttttttttttttgggagactgagtctcgctctgtcgcccaggctggagtgcagtggcgctatctcggctcactgcaagctccgcctcctgggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgta

SEQ ID NO: 458470 - DNA, 5074 bp, Homo sapiens
  misc_feature (1262)..(1262): n is a, c, g, or t
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtgagtataatacttttacaaagttactttcattcattactcccaaatgtgattattaataaaatagtattctaaagagttncatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggactgggcacttggagtcctgcatgccaaaatcattgcagctataacattgatgggtcctcagtggtggttgaaaactgtaattgaacaggtttacgcaaatggcatccggaacattgaccttcactatattgttcgtaaactggcagctcccgtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaacaaaatgtatattaatttattaaatctagttgtcactttattttggacctgctgtgatctcgacaggaaacgtgccacagagcagtagtgcgcaggcaagacttttcagtgacgccttgtggaacgcagttcatgatgtcctagcagctctcactaagggaactgtacattctttctttcttggctattcagaccttaccaagaacgttaaaggaaacaagtagaaatcagcagtggagtgtctgtggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttttaaaaagcgccagtgttcttatggcactacattctcctgcacgttggtgtgttcacgcacattcgcaaacgcaatacaatgtcgacgcggccgcgaat

SEQ ID NO: 458471 - DNA, 4146 bp, Homo sapiens
  misc_feature (1262)..(1262): n is a, c, g, or t
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtgagtataatacttttacaaagttactttcattcattactcccaaatgtgattattaataaaatagtattctaaagagttncatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatggtgatctctgtgctgttgctttccctgtgtgtaccttatgtcatagcttctggtgttgttcctttactaggtgttactgcggaaatgcaaaacttagtccatcggcggatttatccatttttactgatggtcgtggtattgatggcaattttgtccttccaagtccgccagtttaagcgcctttatgaacatattaaaaatgacaagtaccttgtgggtcaacgactcgtgaactacgaacggaaatctggcaaacaaggctcatctccaccacctccacagtcatcccaagaataaagtagttgtctcaacaacttgaccttcccctttacatgtccttttttgtggacttctctctttggagatttttcccagtgatctctcagcgttgtttttaagttaaatgtatttgacttgtgttctcagcattcagagagcagcggtgtaagattctgctgttctccctggatcttctgacattactgctgtctgagatttgtatatgtgtaaatacaagttccttgataccctaaaaccttggattaaacagaatgtgcattgtacatctttaaac

SEQ ID NO: 458472 - DNA, 4026 bp, Homo sapiens
  misc_feature (1262)..(1262): n is a, c, g, or t
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccaggatgacatgaattggaatgctttagaatgggaccgagctgctgaagagcttacatgggaaagaatgctaggacttgatggatcactagtttttctggaacatgtcttctgggtggtatctttaaatacactgttcattcttgtttttgcattttgcccttaccatattggtcatttctcccttgttggtttgggatttgaagaacacgtgagtataatacttttacaaagttactttcattcattactcccaaatgtgattattaataaaatagtattctaaagagttncatcatttcttcattggcattatgcaagggaatagttaggcaataccgtctcattcttttttaaaaaaaataacagtggctcaagagatagtggtcatgttgccaactaatgaaaatgtgctctgaaatccagtcagctgggtgggcctgaggcataccgtgggaaagtttcccacaggctgattttctgtccatctcaagaacctgtatgttctcttctttccctttccccaggtgccccctgctgaatttagaaaagtaacaatatatcaatcaatttaaaaagggtagaatattttggaatgacgggttgtagtgttttctagagtgctttagttttgacattttatcagtattttccagaggtaaataaattttggaaggattattacttctctgttggggccctagaacaatttagtcttttatggaaaagctgactatctgggatcatatgctcagtttgtatatttgagatctgagagatcacgttctgaagtcttctcatatttagtacacctctgattctcactagttgaatgcaagaacttgaaaggttcaggtaagtgttttgaaaaattttgactttccaaacttttgccacttgctatctgaaactcaggaatcaaaaaataccgacaggcactgttactttcaaaattctttctataagttgagaatgggacagatttgcagagcaagggaaacttgaacagttacttctagtggtaggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaatttggttttcagagatgtcatccaaagcagattttacagttgtttcctggttataaattgtctcaacaattctcttttagtcatttagattgtttaatatgggaaaaccggggtgtagaacatgttgtaaaattaaattttatttacttttttcttatttccaggtccaagcatctcattttgaaggcctaatcacaaccatagttgggtatatacttttagcaataacactgataatttgtcatggcttggcaactcttgtgaaatttcatagatctcgtcgcttactgggagtctgctatattgttgttaaggtctctttgttagtggtggtagaaattggagtattccctctcatttgtggttggtggctggatatctgttccttggaaatgtttgatgctactctgaaagatcgagaactgagctttcagtcggctccaggtactaccatgtttctgcattggctagtgggaatggtatatgtcttctactttgcctccttcattctactactgagagaggtacttcgacctggtgtcctgtggtttctaaggaatttgaatgatccagatttcaatccagtacaggaaatgatccatttgccaatatataggcatctccgaagatttattttgtcagtgattgtctttggctccattgtcctcctgatgctttggcttcctatacgtataattaagagtgtgctgcctaattttcttccatacaatgtcatgctctacagtgatgctccagtgagtgaactgtccctcgagctgcttctgcttcaggttgtcttgccagcattactcgaacagggacacacgaggcagtggctgaaggggctggtgcgagcgtggactgtgaccgccggatacttgctggatcttcattcttatttattgggagaccaggaagaaaatgaaaacagtgcaaatcaacaagttaacaataatcagcatgctcgaaataacaacgctattcctgtggtgggagaaggccttcatgcagcccaccaagccatactccagcagggagggcctgttggctttcagccttaccgccgacctttaaattttccactcaggatatttctgttgattgtcttcatgtgtataacattactgattgccagcctcatctgccttactttaccagtatttgctggccgttggttaatgtcgttttggacggggactgccaaaatccatgagctctacacagctgcttgtggtctctatgtttgctggctaaccataagggctgtgacggtgatggtggcatggatgcctcagggacgcagagtgatcttccagaaggttaaagagtggtctctcatgatcatgaagactttgatagttgcggtgctgttggctggagttgtccctctccttctggggctcctgtttgagctggtcattgtggctcccctgagggttcccttggatcagactcctcttttttatccatggcaggtaaatgtatgtcttttgctcatgttatttcattaaggatttgagatcagaaaataatcctagccaggcatggggcttacgcctataatctagcactttgggaggctgaggtgggaggactgcttgcacccaggagttcgagaccagcctgggcagcatggcaagacctagtctctataaaaaattggctcatgcgtctggtcccagctgcttgggaggcaaaggtgagaggatcacaggaggttgaggctgaagtgagccatgttcatgacactgcactgtagcctgggcaacagagtaagagcctctgtccaaaaaa

SEQ ID NO: 458473 - DNA, 2524 bp, Homo sapiens
aggtgttcccgcccctccccctcccgtgtcgctcgctttctgtcagcctctctccctctccctctcccctctccttcctctcgcttcctctctcgcacctgagcgtacgcacctgcccgggcccggctccctcctcctctcccctccctctttccccgcccggccgcgggagcctcgtggctgcgtcaccgccgcccccccagacaagatggacaccgcggaggaagacatatgtagagtgtgtcggtcagaaggaacacctgagaaaccgctttatcatccttgtgtatgtactggcagtattaagtttatccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatcagcctggtgtggttgagagagcagatagtccatgggggagcaccaatttggttggagcatgctgccccaccgttcaatgctgcggggcatcaccaaaatgaggctccagcaggaggaaatggtgcagaaaatgttgctgctgatcagcctgctaacccaccagctgagaacgcagtggtgggggaaaaccctgatgcccaggatgaccaggcagaagaggaggaggaggacaatgaggaggaagatgacgctggtgtggaggatgcggcagatgctaataacggagcccagggtaatggctgcttgtgtgtcctcactcttcagcactgcaaatctgttctcaacttgcattgaggaaaagggctggcgttttcaaatttttaatgttgtgaagttctatttctaacttatttttactttattttggcaaactggcatttatggatgtacatatgcataaatatgtttttttctatgaaacagggcatgttttgtgttttaaaatcctttttacacaggccttttttttttttttgggagactgagtctcgctctgtcgcccaggctggagtgcagtggcgctatctcggctcactgcaagctccgcctcctgggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttga

SEQ ID NO: 458474 - DNA, 1468 bp, Homo sapiens
  misc_feature (8)..(8): n is a, c, g, or t
cgcctggnaccacacccagctaatttttgtactgttagcagaaacagggtttcatcacgttggccaggcgtggtttcgatctcctgacctcgtgatctgcctgctttggcctcccaaagtgctgggattacaggcatgagccactgtgcccggcctttatgctgagttttaagggctgtatgagacaccaggtggtgggagggagctgttttgagagcagggaatttaggatacttaggaaattagaaaattagagaagtcataggatcttggaactaagggagaaccttagagtcctgtggagcagaacccagcatttgtatgtggagaaacggaggcccagagaagttgtgacttatccgggtcactctgcaggtctgggtgtcccacccgagtccatgtcagggctctttctgcacaccaagccccatgcccacctctgtgtgactggctgtggtgggaggggcctcctaggctagaggtgctgggatcccttttcagtccagaaataatgagcttagagggtctggaagtagcatggactaaaacccaggaaggatccacagggactgttgatgccagtgaggactccaggaagccggatcacggggactgttgatgccagtgaggactccaggaagctgctgttgggacagccctgctttgggagtctgaggttccaggaaaccccaggaatccggattctcatccctgagacctactcaggactagcccaggggaccgagctaggaaacctgcttgaggtggtagaggcagccaggggtgtgcagtggtccgggcgggcttcgatcagttccaggttggttgcttctccaaactggctccaagacaggcatgtggctcaagttggtctggactcaatcccgggactttaggacttttgctagaaatctggtgtggtgcaggagcgactccaggattcactctgtgggctgctgtggactcagactcccccaggactagaggctgcttctccctggtgggaggagttacaaccttgcaagggttctaaagacccccgggtgctgggtggtgggcttttcctgacaacttccataagttattggaacctaaattcacactgcttagcatcgtaatagtctgatcaaccctgctcagtgttgtcatacttgccctattaccagggagagaaatagagaggtgggtgcctccctagagtatccacccacactgtgtactgaatgcccctcctcaacctgtctctcgtggggacctgcacctgcttttcctactaactgctggcttgtatttattcccctaaagcctgttccataacccagtgtggttcttagacttgagcaaacctcagaaacacctggagggcttatccccagtcctgattctgtaggtctggggtgaggccttatagtgtgcattttaacaacgtccccagtgtttcccaatgctgctggtgcacaccaagtgt

SEQ ID NO: 458475 - DNA, 5058 bp, Homo sapiens
  misc_feature (1395)..(1395): n is a, c, g, or t
tctcagatcctgacggtgcagcagcccgcagcctcagccagggagtcccagccgctttcaatggaggagaagcccggccagccacagcctcagcaccatcacagccaccaccatccgcaccatcaccctcagcagcagcagcagcagccgcaccaccaccaccattattatttctacaaccacagccacaaccaccaccaccaccatcatcaccagcagcctcaccaatacctgcagcatggagccgagggcagccccaaggcccagccaaagccgctgaaacatgagcagaaacacaccctccagcagcaccaggaaacgccgaagaagaaaacaggctatggtgaactaaacggtaatgctggagaaagagaaatatctttaaagaacctgagttctgatgaagccaccaaccctatttccagggtcctcaatggcaaccagcaagttgtagacactagcctgaagcagactgtaaaggccaacacctttgggaaagcaggaattaaaaccaagaatttcattcagaaaaacagtatggacaaaaagaatgggaagtcttatgaaaataaatctggagagaatcagtctgtagataagtctgatactataccaattccaaatggtgtggtaacaaataattctggttatattactaatggttatatgggtaaaggagcagataatgatggtagtggatctgagagcggatatacaactcctaaaaaaaggaaagctaggcgcaatagtgccaagggttgtgaaaaccttaatatagtgcaggacaaaataatgcaacaagagaccagtgtcccaaccttaaaacagggacttgaaactttcaagcctgactatagtgaacaaaagggaaatcgagtagatggttcgaagcccatttggaagtatgaaactgggcctggaggaacaagtcgaggaaaacctgctgtgggtgatatgcttcggaaaagctcagatagtaaacctggtgtgagcagcaaaaagtttgatgatcggcccaaaggaaagcatgcttcagctgttgcctccaaagaggactcgtggaccctatttaaaccacccccagtttttccagtggacaatagcagtgctaaaatagttcctaaaataagttatgcaagcaaagttaaggaaaacctcaacaaaactatacagaactcttctgtgtcaccaacttcatcttcatcatcttcatcatctaccggggaaactcagacccaatcatcaagtcgcttatcccaggtccctatgtcagcgctgaaatctgttacttctgccaacttttctaatgggcctgttttagcagggactgatggaaatgtttatcctccagggggtcagccactgctaactactgctgctaatactctaacaccnatctcttctgggacagattcagttctccaggacatgagtctaacttcagcagctgttgaacaaattaagactagcctttttatctatccttcaaatatgcaaactatgctgttgagcacagcacaagtggatctgccctctcagacagatcagcaaaacctgggggatatcttccagaatcagtggggtttatcatttataaatgagcccagtgctggccctgagactgttactgggaagtcatcagagcataaagtgatggaggtgacatttcaaggagaatatcctgctactttggtttcacagggtgctgaaataattccctcaggaactgagcatcctgtgtttcccaaggcttacgagctggagaaacggactagtcctcaagttctgggtagcattctaaaatctgggactactagtgagagtggagccttatccttggaacccagtcatataggtgacctgcagaaagcagacaccagtagtcaaggtgctttagtgtttctctcaaaggactacgagatagaaagtcaaaatcctctggcctctcctacgaacactttgttaggctctgccaaagaacagagataccagagaggcctagaaaggaatgatagctggggttcttttgacctgagggctgctattgtatatcacactaaagaaatggaatctatttggaatttgcagaagcaagatcccaaaaggataatcacttacaatgaagccatggatagtccagatcaatgaaggaccagactgcctattcgtaacctttctgcagcattagagccatcgttcatgggggacacaaggcttttatgctcctagatcttcaacgcagcagaggaaccataagtagaatcacaggataatatatacaaatatatatatatacatatatatatatatagttatttaaaaaaggcaactgaaagtaattagacttcttaaggaatcaaatttatttcaagagactacacatggttatttaatctccggtactgaataggttttttttcttctgttagtttttgtttttaagtgtgaatgcaagtgattaatgaatacagacttaacaagtgtggttctaaagttcctgctgtcatcaacttgggcaacaaatgacccactggaaaggcaaatccacttaaaagatctctgtatcttgttctgtgactgaagtgatacactaatcacggggaacccagaatgattcaacattttccccccactcctcccttgatctttttggttttactttaattaagccctgcgagaatgctggataaatgccttgaagttagcagggtgtatttttttagcgaatatgatttgcatgtcttgccaggagttaagcggcctctggggtgttggggaaatactttatttctttccatttattttttgtggggcggggataggggagggcattgaagttctacaattctggaatagttagttgatggtacatagttaacttggcttcggttacatattggactttaacaactgaagaatctatgcgtgtcatttaaagaaaagttgcagaacaagcaattggcttagatatacaatctggaaaaatattcctgtgcccatattttaatgtaattgtataactgggagcaaaaatatattctgcttttcaactgtaggtgctccagacttgctctccgtcactaacactaaatgtgctgttttccttgtttttcatcaaacatttaagacaaacttagacctttctgtaaattatcttttaatttctcagcaaaatctaaaaggggaagaaaaaagtccatgaaaactaaaacttttcatgtttttagccagtgagaagataataaaccctgactgtagaaggtgtgttttcatgcaaactatacttctgagcttgttagcttctaattatatcttaataaatatattttattactagagcaagatgggtttttaaggaaaataatgtgaaattctggaaattttctttggggcagagaagagcattagccctgtcttatcattacattgccatcctgttgcactgcagcttgtgtatagcatgctaaaataaatttttgtgtgtgtgtgcagaaattaagggtccaattgagattgggtgatgttagtaacataataacaagttgtctggcctgacacagcatcacatcacacacacagaaattagtatatccatgtatgtcaaatacaggttaaaatatcagggcatttatataaagagttgtagtcttctgataaaagtagactggatcccctggggtatttggggagaaagtaactactttggctctacccctagaaatgtccagttttgagtgactgtagtatggatgggttttcttgttttgttgattatttgaggcttttaaaacaagtagttcatgaaagaagctgttggactcaacatagagtagagtaactatctttttagtctggatttctgccctgcttagattttaaaagtataagcatggattgccaattccacttgatgtaaacaaaacttttttttatacataatatatatatatatatataaaataacttattgtatcagtccaggttcagaaacttgtggtaggccagttccagatagtttcatttcacctgtaaactgtatcactttgactgatattgtaattttcaaatgtataatatgtttacagatgtgccctgcatttagtctgccttgttcctattttgatttttgttgagtctcctgcctgcttgccaaaagctaggatgcttcaggcccatgtacaattgaaagcagaggcatccttgagctttaaagcattgaacaaactggaaaatgcaacataccacataactgaagtgaaaaaagtctgtgtttttgtgtttttttaaataaaaattttcaaaaagttaaaaaaaaagacatataaggttgattaaagggaaaaaaggctccagtttgttttacaggttttaaagttctgctgtgtgttcaattgccttgtgtaaccacttgtcgccttagggccagattcccctctctagtccccttttttaaatgtccattttgcttgcctggaattttaaagttcttccgtctcacaactcacaagaaactttctgggtttgtgacatacagaggttgaattgagtatatatttgaaaaggaaaaaacaaaaaacaaacccagaccccacctgaattgggctttttaacttagaagcaacacttgattaaacatctttagaaagctattgcttttctaatttccttccatatccctcaggcctcagtgttcagagaagccaaaaagaatgtatcacttctctgtctgtccaaaggtttttgagagtctcacttctaaatgaaacaatgcaacatttcactttgatttctccactgaaatttccttgattatatggttagaggtatgtagttaggaatgtctgttaactttctgagaaccctagtgccccatcatattaactgtcagtattttgggggcattaggttaatagacttaattgcctaggtacaagcaggactttgggacaaatctctttgtgctgtttggtaacacttaactctatttgttgcaatctttctccttaggtcctcacacaattccttacagagcacttattaaaaaaaaatcttaagagt

SEQ ID NO: 458476 - DNA, 542 bp, Homo sapiens
gtaaacataataagtaaaattgtggaaagacgttgtaatattgaagggatagtcaaaaaacaaacccagaccccacctgaattgggctttttaacttagaagcaacacttgattaaacatctttagaaagctattgcttttctaatttccttccatatccctcaggcctcagtgttcagagaagccaaaaagaatgtatcacttctctgtctgtccaaaggtttttgagagtctcacttctaaatgaaacaatgcaacatttcactttgatttctccactgaaatttccttgattatatggttagaggtatgtagttaggaatgtctgttaactttctgagaaccctagtgccccatcatattaactgtcagtattttgggggcattaggttaatagacttaattgcctaggtacaagcaggactttgggacaaatctctttgtgctgtttggtaacacttaactctatttgttgcaatctttctccttaggtcctcacacaattccttacagagcacttattaaaaaaaaatcttaagagt

SEQ ID NO: 458477 - DNA, 4876 bp, Homo sapiens
  misc_feature (1213)..(1213): n is a, c, g, or t
ctgacaggtgtcttctcatagagatgtgaaataatataaagctacagctcatcgcatagtgtctagcatacagtaaatagttcttaaatgttaggtattagtgtaatttacatgttgtgatttttttttttaatcctttttttcccctcccctaggctatggtgaactaaacggtaatgctggagaaagagaaatatctttaaagaacctgagttctgatgaagccaccaaccctatttccagggtcctcaatggcaaccagcaagttgtagacactagcctgaagcagactgtaaaggccaacacctttgggaaagcaggaattaaaaccaagaatttcattcagaaaaacagtatggacaaaaagaatgggaagtcttatgaaaataaatctggagagaatcagtctgtagataagtctgatactataccaattccaaatggtgtggtaacaaataattctggttatattactaatggttatatgggtaaaggagcagataatgatggtagtggatctgagagcggatatacaactcctaaaaaaaggaaagctaggcgcaatagtgccaagggttgtgaaaaccttaatatagtgcaggacaaaataatgcaacaagagaccagtgtcccaaccttaaaacagggacttgaaactttcaagcctgactatagtgaacaaaagggaaatcgagtagatggttcgaagcccatttggaagtatgaaactgggcctggaggaacaagtcgaggaaaacctgctgtgggtgatatgcttcggaaaagctcagatagtaaacctggtgtgagcagcaaaaagtttgatgatcggcccaaaggaaagcatgcttcagctgttgcctccaaagaggactcgtggaccctatttaaaccacccccagtttttccagtggacaatagcagtgctaaaatagttcctaaaataagttatgcaagcaaagttaaggaaaacctcaacaaaactatacagaactcttctgtgtcaccaacttcatcttcatcatcttcatcatctaccggggaaactcagacccaatcatcaagtcgcttatcccaggtccctatgtcagcgctgaaatctgttacttctgccaacttttctaatgggcctgttttagcagggactgatggaaatgtttatcctccagggggtcagccactgctaactactgctgctaatactctaacaccnatctcttctgggacagattcagttctccaggacatgagtctaacttcagcagctgttgaacaaattaagactagcctttttatctatccttcaaatatgcaaactatgctgttgagcacagcacaagtggatctgccctctcagacagatcagcaaaacctgggggatatcttccagaatcagtggggtttatcatttataaatgagcccagtgctggccctgagactgttactgggaagtcatcagagcataaagtgatggaggtgacatttcaaggagaatatcctgctactttggtttcacagggtgctgaaataattccctcaggaactgagcatcctgtgtttcccaaggcttacgagctggagaaacggactagtcctcaagttctgggtagcattctaaaatctgggactactagtgagagtggagccttatccttggaacccagtcatataggtgacctgcagaaagcagacaccagtagtcaaggtgctttagtgtttctctcaaaggactacgagatagaaagtcaaaatcctctggcctctcctacgaacactttgttaggctctgccaaagaacagagataccagagaggcctagaaaggaatgatagctggggttcttttgacctgagggctgctattgtatatcacactaaagaaatggaatctatttggaatttgcagaagcaagatcccaaaaggataatcacttacaatgaagccatggatagtccagatcaatgaaggaccagactgcctattcgtaacctttctgcagcattagagccatcgttcatgggggacacaaggcttttatgctcctagatcttcaacgcagcagaggaaccataagtagaatcacaggataatatatacaaatatatatatatacatatatatatatatagttatttaaaaaaggcaactgaaagtaattagacttcttaaggaatcaaatttatttcaagagactacacatggttatttaatctccggtactgaataggttttttttcttctgttagtttttgtttttaagtgtgaatgcaagtgattaatgaatacagacttaacaagtgtggttctaaagttcctgctgtcatcaacttgggcaacaaatgacccactggaaaggcaaatccacttaaaagatctctgtatcttgttctgtgactgaagtgatacactaatcacggggaacccagaatgattcaacattttccccccactcctcccttgatctttttggttttactttaattaagccctgcgagaatgctggataaatgccttgaagttagcagggtgtatttttttagcgaatatgatttgcatgtcttgccaggagttaagcggcctctggggtgttggggaaatactttatttctttccatttattttttgtggggcggggataggggagggcattgaagttctacaattctggaatagttagttgatggtacatagttaacttggcttcggttacatattggactttaacaactgaagaatctatgcgtgtcatttaaagaaaagttgcagaacaagcaattggcttagatatacaatctggaaaaatattcctgtgcccatattttaatgtaattgtataactgggagcaaaaatatattctgcttttcaactgtaggtgctccagacttgctctccgtcactaacactaaatgtgctgttttccttgtttttcatcaaacatttaagacaaacttagacctttctgtaaattatcttttaatttctcagcaaaatctaaaaggggaagaaaaaagtccatgaaaactaaaacttttcatgtttttagccagtgagaagataataaaccctgactgtagaaggtgtgttttcatgcaaactatacttctgagcttgttagcttctaattatatcttaataaatatattttattactagagcaagatgggtttttaaggaaaataatgtgaaattctggaaattttctttggggcagagaagagcattagccctgtcttatcattacattgccatcctgttgcactgcagcttgtgtatagcatgctaaaataaatttttgtgtgtgtgtgcagaaattaagggtccaattgagattgggtgatgttagtaacataataacaagttgtctggcctgacacagcatcacatcacacacacagaaattagtatatccatgtatgtcaaatacaggttaaaatatcagggcatttatataaagagttgtagtcttctgataaaagtagactggatcccctggggtatttggggagaaagtaactactttggctctacccctagaaatgtccagttttgagtgactgtagtatggatgggttttcttgttttgttgattatttgaggcttttaaaacaagtagttcatgaaagaagctgttggactcaacatagagtagagtaactatctttttagtctggatttctgccctgcttagattttaaaagtataagcatggattgccaattccacttgatgtaaacaaaacttttttttatacataatatatatatatatatataaaataacttattgtatcagtccaggttcagaaacttgtggtaggccagttccagatagtttcatttcacctgtaaactgtatcactttgactgatattgtaattttcaaatgtataatatgtttacagatgtgccctgcatttagtctgccttgttcctattttgatttttgttgagtctcctgcctgcttgccaaaagctaggatgcttcaggcccatgtacaattgaaagcagaggcatccttgagctttaaagcattgaacaaactggaaaatgcaacataccacataactgaagtgaaaaaagtctgtgtttttgtgtttttttaaataaaaattttcaaaaagttaaaaaaaaagacatataaggttgattaaagggaaaaaaggctccagtttgttttacaggttttaaagttctgctgtgtgttcaattgccttgtgtaaccacttgtcgccttagggccagattcccctctctagtccccttttttaaatgtccattttgcttgcctggaattttaaagttcttccgtctcacaactcacaagaaactttctgggtttgtgacatacagaggttgaattgagtatatatttgaaaaggaaaaaacaaaaaacaaacccagaccccacctgaattgggctttttaacttagaagcaacacttgattaaacatctttagaaagctattgcttttctaatttccttccatatccctcaggcctcagtgttcagagaagccaaaaagaatgtatcacttctctgtctgtccaaaggtttttgagagtctcacttctaaatgaaacaatgcaacatttcactttgatttctccactgaaatttccttgattatatggttagaggtatgtagttaggaatgtctgttaactttctgagaaccctagtgccccatcatattaactgtcagtattttgggggcattaggttaatagacttaattgcctaggtacaagcaggactttgggacaaatctctttgtgctgtttggtaacacttaactctatttgttgcaatctttctccttaggtcctcacacaattccttacagagcacttattaaaaaaaaatcttaagagt

SEQ ID NO: 458478 - DNA, 5915 bp, Homo sapiens
  misc_feature (1395)..(1395): n is a, c, g, or t
tctcagatcctgacggtgcagcagcccgcagcctcagccagggagtcccagccgctttcaatggaggagaagcccggccagccacagcctcagcaccatcacagccaccaccatccgcaccatcaccctcagcagcagcagcagcagccgcaccaccaccaccattattatttctacaaccacagccacaaccaccaccaccaccatcatcaccagcagcctcaccaatacctgcagcatggagccgagggcagccccaaggcccagccaaagccgctgaaacatgagcagaaacacaccctccagcagcaccaggaaacgccgaagaagaaaacaggctatggtgaactaaacggtaatgctggagaaagagaaatatctttaaagaacctgagttctgatgaagccaccaaccctatttccagggtcctcaatggcaaccagcaagttgtagacactagcctgaagcagactgtaaaggccaacacctttgggaaagcaggaattaaaaccaagaatttcattcagaaaaacagtatggacaaaaagaatgggaagtcttatgaaaataaatctggagagaatcagtctgtagataagtctgatactataccaattccaaatggtgtggtaacaaataattctggttatattactaatggttatatgggtaaaggagcagataatgatggtagtggatctgagagcggatatacaactcctaaaaaaaggaaagctaggcgcaatagtgccaagggttgtgaaaaccttaatatagtgcaggacaaaataatgcaacaagagaccagtgtcccaaccttaaaacagggacttgaaactttcaagcctgactatagtgaacaaaagggaaatcgagtagatggttcgaagcccatttggaagtatgaaactgggcctggaggaacaagtcgaggaaaacctgctgtgggtgatatgcttcggaaaagctcagatagtaaacctggtgtgagcagcaaaaagtttgatgatcggcccaaaggaaagcatgcttcagctgttgcctccaaagaggactcgtggaccctatttaaaccacccccagtttttccagtggacaatagcagtgctaaaatagttcctaaaataagttatgcaagcaaagttaaggaaaacctcaacaaaactatacagaactcttctgtgtcaccaacttcatcttcatcatcttcatcatctaccggggaaactcagacccaatcatcaagtcgcttatcccaggtccctatgtcagcgctgaaatctgttacttctgccaacttttctaatgggcctgttttagcagggactgatggaaatgtttatcctccagggggtcagccactgctaactactgctgctaatactctaacaccnatctcttctgggacagattcagttctccaggacatgagtctaacttcagcagctgttgaacaaattaagactagcctttttatctatccttcaaatatgcaaactatgctgttgagcacagcacaagtggatctgccctctcagacagatcagcaaaacctgggggatatcttccagaatcagtggggtttatcatttataaatgagcccagtgctggccctgagactgttactgggaagtcatcagagcataaagtgatggaggtgacatttcaaggagaatatcctgctactttggtttcacagggtgctgaaataattccctcaggaactgagcatcctgtgtttcccaaggcttacgagctggagaaacggactagtcctcaagttctgggtagcattctaaaatctgggactactagtgagagtggagccttatccttggaacccagtcatataggtgacctgcagaaagcagacaccagtagtcaaggtgctttagtgtttctctcaaaggactacgagatagaaagtcaaaatcctctggcctctcctacgaacactttgttaggctctgccaaagaacagagataccagagaggcctagaaaggaatgatagctggggttcttttgacctgagggctgctattgtatatcacactaaagaaatggaatctatttggaatttgcagaagcaagatcccaaaaggataatcacttacaatgaagccatggatagtccagatcaatgaaggaccagactgcctattcgtaacctttctgcagcattagagccatcgttcatgggggacacaaggcttttatgctcctagatcttcaacgcagcagaggaaccataagtagaatcacaggataatatatacaaatatatatatatacatatatatatatatagttatttaaaaaaggcaactgaaagtaattagacttcttaaggaatcaaatttatttcaagagactacacatggttatttaatctccggtactgaataggttttttttcttctgttagtttttgtttttaagtgtgaatgcaagtgattaatgaatacagacttaacaagtgtggttctaaagttcctgctgtcatcaacttgggcaacaaatgacccactggaaaggcaaatccacttaaaagatctctgtatcttgttctgtgactgaagtgatacactaatcacggggaacccagaatgattcaacattttccccccactcctcccttgatctttttggttttactttaattaagccctgcgagaatgctggataaatgccttgaagttagcagggtgtatttttttagcgaatatgatttgcatgtcttgccaggagttaagcggcctctggggtgttggggaaatactttatttctttccatttattttttgtggggcggggataggggagggcattgaagttctacaattctggaatagttagttgatggtacatagttaacttggcttcggttacatattggactttaacaactgaagaatctatgcgtgtcatttaaagaaaagttgcagaacaagcaattggcttagatatacaatctggaaaaatattcctgtgcccatattttaatgtaattgtataactgggagcaaaaatatattctgcttttcaactgtaggtgctccagacttgctctccgtcactaacactaaatgtgctgttttccttgtttttcatcaaacatttaagacaaacttagacctttctgtaaattatcttttaatttctcagcaaaatctaaaaggggaagaaaaaagtccatgaaaactaaaacttttcatgtttttagccagtgagaagataataaaccctgactgtagaaggtgtgttttcatgcaaactatacttctgagcttgttagcttctaattatatcttaataaatatattttattactagagcaagatgggtttttaaggaaaataatgtgaaattctggaaattttctttggggcagagaagagcattagccctgtcttatcattacattgccatcctgttgcactgcagcttgtgtatagcatgctaaaataaatttttgtgtgtgtgtgcagaaattaagggtccaattgagattgggtgatgttagtaacataataacaagttgtctggcctgacacagcatcacatcacacacacagaaattagtatatccatgtatgtcaaatacaggttaaaatatcagggcatttatataaagagttgtagtcttctgataaaagtagactggatcccctggggtatttggggagaaagtaactactttggctctacccctagaaatgtccagttttgagtgactgtagtatggatgggttttcttgttttgttgattatttgaggcttttaaaacaagtagttcatgaaagaagctgttggactcaacatagagtagagtaactatctttttagtctggatttctgccctgcttagattttaaaagtataagcatggattgccaattccacttgatgtaaacaaaacttttttttatacataatatatatatatatatataaaataacttattgtatcagtccaggttcagaaacttgtggtaggccagttccagatagtttcatttcacctgtaaactgtatcactttgactgatattgtaattttcaaatgtataatatgtttacagatgtgccctgcatttagtctgccttgttcctattttgatttttgttgagtctcctgcctgcttgccaaaagctaggatgcttcaggcccatgtacaattgaaagcagaggcatccttgagctttaaagcattgaacaaactggaaaatgcaacataccacataactgaagtgaaaaaagtctgtgtttttgtgtttttttaaataaaaattttcaaaaagttaaaaaaaaagacatataaggttgattaaagggaaaaaaggctccagtttgttttacaggttttaaagttctgctgtgtgttcaattgccttgtgtaaccacttgtcgccttagggccagattcccctctctagtccccttttttaaatgtccattttgcttgcctggaattttaaagttcttccgtctcacaactcacaagaaactttctgggtttgtgacatacagaggttgaattgagtatatatttgaaaaggaaaaaacaaaaaacaaacccagaccccacctgaattgggctttttaacttagaagcaacacttgattaaacatctttagaaagctattgcttttctaatttccttccatatccctcaggcctcagtgttcagagaagccaaaaagaatgtatcacttctctgtctgtccaaaggtttttgagagtctcacttctaaatgaaacaatgcaacatttcactttgatttctccactgaaatttccttgattatatggttagaggtatgtagttaggaatgtctgttaactttctgagaaccctagtgccccatcatattaactgtcagtattttgggggcattaggttaatagacttaattgcctaggtacaagcaggactttgggacaaatctctttgtgctgtttggtaacacttaactctatttgttgcaatctttctccttaggtcctcacacaattccttacagagcacttattaaaaaaaaatcttaagagttgatctgttttctgattattttgtgtaagcttctaaacaaacttcagctgtgattaatttagcacatttaaataacgtgttattgtttggtataaagaattttccttcaactcagagtattagtactgtagcataaaccaaatacagtctagaggggatttttaacatccctccattataaagactgaaaaaggggtgtgtgtgtgtgtgtgtgttatgtatgtatgtatgtgtgtgtgaggaaaagatggagatattaaaaattagtaaatgaatgtgtataagacattagtattcagagaatgaacttgtatttattttgtgccatttgttttcattacacagaaaaaagtcaggtggtttaaatccttaaaagggtagtattgaaaaatggcactaagaatgaaattatgacctatttttttaatagctatgaagatactaattatgggtgaagatttctttttaaatctgttttgattattgtaggcttctgtgtcacataccactcttgtaggtgtcctcaataatccccttttcccacaaaatacacagggtgtattatctttctctttattcacccccactttgctgaactgaagttaattacatagcctttcttctaacctccttagtaatgaaccttcacataaagtgtatttacagcgtctgtggtagccagcccttcctcctctactttctaggaggggatagccaataactaggaatttaatgacagatttttttttctttgaaataaatggccagagtttctccattttagaattttgttgtcctccttaatcatctgcttacctagtcattactcaatctgcagaaacttcataaaggaaaag

SEQ ID NO: 458479 - DNA, 707 bp, Homo sapiens
gctctgaacttggaggcagagacccaagcagctggaggctctgtgtgtggcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcaggtgctccagtaatggacagctaggcagagcaacggtcttcctcgcagtcaactggcgcagttccattccaccgtctcgtggactggccacaattttccaatgggaaccgggccactaggtagccccaacgcaagggcaatgggaccggggtcccgtgacatcccttaaggaaggttaattcgccccgtttccgcaccgcgctggggacccccacaatggcccttgtcacaccgggcccgggttaacc

SEQ ID NO: 458480 - DNA, 2549 bp, Homo sapiens
gctctgaacttggaggcagagacccaagcagctggaggctctgtgtgtgggtcgctgatttcttggagcctgaaaagaagcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaaaaaaaaaaaaaacaaagacaacaagctgtcacaaaaaaaagaacagaaaaaaaaaaaaaaaaagggggggcgacaaaaaaacaccccacaggggcaccacagaggacggcaacccccgaaagtgcaaacacaaggggccaccccaacaaggagcacctcaataagagagcacgagcagacgggcacgcgcgtaaaacacggcgcgtcacagaccggcggaaacaaccgcgcacacccgcgggaaactcctggcaaaaggagccgcctcacacacgagaggagggcacgcaaacacatgggggacaaacatacccacgaagcagtcaacacgcgccgaaagcgcagactacacaccacgagacgcgaca

SEQ ID NO: 458481 - DNA, 2665 bp, Homo sapiens
gctctgaacttggaggcagagacccaagcagctggaggctctgtgtgtgggtcgctgatttcttggagcctgaaaagaaggtaactgggcatatgagggacagatggagtgagtcagtgacaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaaaaaaaaaaaaaaaaaaagattaaaaggaaaaagaactcaattacaaacaaaaaaaaaagggggggcggcgccctgaagaaattccccgaggagggcgcaacatgtttgcagctaccccaccgatgttgtgtgcaagaaggggggcccaaaaaggaggacgggttataatacacgaagcacgcggccgcgccgtaataacaaacgcgtgtgacagcgggaaaaaaagagcgctccgtcggggagcactcgggagaacggaacaccatactcaggggggcgggcgaaccactgtgcggcaacacaagcaccccagagaggatatagagccccaacaggcgaacgatatacaaagtcagggcgacatatcgtcgttcaaaccacaggaatataacgtgccggagaaaatgtgcccaccgagcagactgatcgacacactttttacgg

SEQ ID NO: 458482 - DNA, 2790 bp, Homo sapiens
gctctgaacttggaggcagagacccaagcagctggaggctctgtgtgtggatccatccctaccagggactcagcagggcctaagcagggggagtgggagaacagaccccaagaggaaggaagacctcatcactgactgtgagagggtcatcaccccccgatgatcaccttgaagggtccaggctgtgggccctattcatctcttttcattctcaggtcgctgatttcttggagcctgaaaagaagcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaaaaaaaaaaaaaaaaaaagattaaaaggaaaaagaactcaattacaaacaaaaaaaaaagggggggcggcgccctgaagaaattccccgaggagggcgcaacatgtttgcagctaccccaccgatgttgtgtgcaagaaggggggcccaaaaaggaggacgggttataatacacgaagcacgcggccgcgccgtaataacaaacgcgtgtgacagcgggaaaaaaagagcgctccgtcggggagcactcgggagaacggaacaccatactcaggggggcgggcgaaccactgtgcggcaacacaagcaccccagagaggatatagagccccaacaggcgaacgatatacaaagtcagggcgacatatcgtcgttcaaaccacaggaatataacgtgccggagaaaatgtgcccaccgagcagactgatcgacacactttttacgg

SEQ ID NO: 458483 - DNA, 2595 bp, Homo sapiens
gctctgaacttggaggcagagacccaagcagctggaggctctgtgtgtggcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaaaaaaaaaaaaaaaaaaagattaaaaggaaaaagaactcaattacaaacaaaaaaaaaagggggggcggcgccctgaagaaattccccgaggagggcgcaacatgtttgcagctaccccaccgatgttgtgtgcaagaaggggggcccaaaaaggaggacgggttataatacacgaagcacgcggccgcgccgtaataacaaacgcgtgtgacagcgggaaaaaaagagcgctccgtcggggagcactcgggagaacggaacaccatactcaggggggcgggcgaaccactgtgcggcaacacaagcaccccagagaggatatagagccccaacaggcgaacgatatacaaagtcagggcgacatatcgtcgttcaaaccacaggaatataacgtgccggagaaaatgtgcccaccgagcagactgatcgacacactttttacgg

SEQ ID NO: 458484 - DNA, 1800 bp, Homo sapiens
gcgtctagaggatctccatctcaggcaggacgatctcaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaaaaaaaaaaaaaaaaaaagattaaaaggaaaaagaactcaattacaaacaaaaaaaaaagggggggcggcgccctgaagaaattccccgaggagggcgcaacatgtttgcagctaccccaccgatgttgtgtgcaagaaggggggcccaaaaaggaggacgggttataatacacgaagcacgcggccgcgccgtaataacaaacgcgtgtgacagcgggaaaaaaagagcgctccgtcggggagcactcgggagaacggaacaccatactcaggggggcgggcgaaccactgtgcggcaacacaagcaccccagagaggatatagagccccaacaggcgaacgatatacaaagtcagggcgacatatcgtcgttcaaaccacaggaatataacgtgccggagaaaatgtgcccaccgagcagactgatcgacacactttttacgg

SEQ ID NO: 458485 - DNA, 1881 bp, Homo sapiens
aggacagggaggatcctgtctggccttcagcctccatcctgaagctccacttggtttgtgagatgctgaaactccctttcaacagaattcacttgtggctattagagctggaggcacccttagctacttcattcccctgatgggccctgactcttccccataatcactgaccagccttgacactccccttgcaaaccctcccagcactgcaccccaggcagccactcctaacctttgcctttggcatgagatgcaaccctccttattctctatctggtccagttccttcacttacagatggtagcagtgaggtcttggggtagaaggaccctccgaagtcacacagagtgcctgcttcctggtgcccttagctctccctctgcagcccagtgccatcaggatgagcagtcccagccaagcataatgacagagagaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaaaaaaaaaaaaaaaaaaagattaaaaggaaaaagaactcaattacaaacaaaaaaaaaagggggggcggcgccctgaagaaattccccgaggagggcgcaacatgtttgcagctaccccaccgatgttgtgtgcaagaaggggggcccaaaaaggaggacgggttataatacacgaagcacgcggccgcgccgtaataacaaacgcgtgtgacagcgggaaaaaaagagcgctccgtcggggagcactcgggagaacggaacaccatactcaggggggcgggcgaaccactgtgcggcaacacaagcaccccagagaggatatagagccccaacaggcgaacgatatacaaagtcagggcgacatatcgtcgttcaaaccacaggaatataacgtgccggagaaaatgtgcccaccgagcagactgatcgacacactttttacgg

SEQ ID NO: 458486 - DNA, 2166 bp, Homo sapiens
gctctgaacttggaggcagagacccaagcagctggaggctctgtgtgtgggtcgctgatttcttggagcctgaaaagaagcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaaccgtgacaagtgggccgagctgatat

SEQ ID NO: 458487 - DNA, 2375 bp, Homo sapiens
gctctgaacttggaggcagagacccaagcagctggaggctctgtgtgtgggtcgctgatttcttggagcctgaaaagaagcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaatttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaaaaaaaaaaaaaaaaaaagattaaaaggaaaaagaactcaattacaaacaaaaaaaaaagggggggcggcgccctgaagaaattccccgaggagggcgcaacatgtttgcagctaccccaccgatgttgtgtgcaagaaggggggcccaaaaaggaggacgggttataatacacgaagcacgcggccgcgccgtaataacaaacgcgtgtgacagcgggaaaaaaagagcgctccgtcggggagcactcgggagaacggaacaccatactcaggggggcgggcgaaccactgtgcggcaacacaagcaccccagagaggatatagagccccaacaggcgaacgatatacaaagtcagggcgacatatcgtcgttcaaaccacaggaatataacgtgccggagaaaatgtgcccaccgagcagactgatcgacacactttttacgg

SEQ ID NO: 458488 - DNA, 1822 bp, Homo sapiens
gctctgaacttggaggcagagacccaagcagctggaggctctgtgtgtgggtcgctgatttcttggagcctgaaaagaagcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgatctgtgctacggagaatactctagattctacctacgaagcatgccagctttgcccaac

SEQ ID NO: 458489 - DNA, 770 bp, Homo sapiens
cagagacccaagcagctggaggctctgtgtgtgggtgagtttagccacatcccctaggtgttctccagcttgaggatcgcaggcagagaggaccagcccagcagccacaggcctgaccaaggcccaggttgggaaggagggcaactccccattttccactgggaggtgtttcacagcatggtcaacatggatgacctacaaagaccctcatgctttgatatcttccttggccagatccatccctaccagggactcagcagggcctaagcagggggagtgggagaacagaccccaagaggaaggaagacctcatcactgactgtgagagggtcatcaccccccgatgatcaccttgaagggtccaggctgtgggccctattcatctcttttcattctcaggtcgctgatttcttggagcctgaaaagaaggtaactgggcatatgagggacagatggagtgagtcagtgagtgagtgacctcatccttccttctaacagcctgggagggacagggcaggttttctgcagagcatggaagattcagctgaaatcagagaggtgaagccagtttcccagggtaacatagtgaggcactgaaagaaaggagactgcactggagcccaggtccctgggctccccagagctccttactcttcctcctcctcagcagtcttgagaccccacaacctccagccggaggcctgaagcatgaggccatgccaggtgccaggtgatgcttggaattttcccgggtgcttcgggtcttccca

SEQ ID NO: 458490 - DNA, 2625 bp, Homo sapiens
gctctgaacttggaggcagagacccaagcagctggaggctctgtgtgtgggtcgctgatttcttggagcctgaaaagaagcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaaaaaaaaaaaaaaaaaaagattaaaaggaaaaagaactcaattacaaacaaaaaaaaaagggggggcggcgccctgaagaaattccccgaggagggcgcaacatgtttgcagctaccccaccgatgttgtgtgcaagaaggggggcccaaaaaggaggacgggttataatacacgaagcacgcggccgcgccgtaataacaaacgcgtgtgacagcgggaaaaaaagagcgctccgtcggggagcactcgggagaacggaacaccatactcaggggggcgggcgaaccactgtgcggcaacacaagcaccccagagaggatatagagccccaacaggcgaacgatatacaaagtcagggcgacatatcgtcgttcaaaccacaggaatataacgtgccggagaaaatgtgcccaccgagcagactgatcgacacactttttacgg

SEQ ID NO: 458491 - DNA, 2572 bp, Homo sapiens
gctctgaacttggaggcagagacccaagcagctggaggctctgtgtgtgggtcgctgatttcttggagcctgaaaagaagcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaaaaaaaaaaaaaaaaaaagattaaaaggaaaaagaactcaattacaaacaaaaaaaaaagggggggcggcgccctgaagaaattccccgaggagggcgcaacatgtttgcagctaccccaccgatgttgtgtgcaagaaggggggcccaaaaaggaggacgggttataatacacgaagcacgcggccgcgccgtaataacaaacgcgtgtgacagcgggaaaaaaagagcgctccgtcggggagcactcgggagaacggaacaccatactcaggggggcgggcgaaccactgtgcggcaacacaagcaccccagagaggatatagagccccaacaggcgaacgatatacaaagtcagggcgacatatcgtcgttcaaaccacaggaatataacgtgccggagaaaatgtgcccaccgagcagactgatcgacacactttttacgg

SEQ ID NO: 458492 - DNA, 2718 bp, Homo sapiens
gctctgaacttggaggcagagacccaagcagctggaggctctgtgtgtgggtgagtttagccacatcccctaggtgttctccagcttgaggatcgcaggcagagaggaccagcccagcagccacaggcctgaccaaggcccaggtcgctgatttcttggagcctgaaaagaagcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaaaaaaaaaaaaaaaaaaagattaaaaggaaaaagaactcaattacaaacaaaaaaaaaagggggggcggcgccctgaagaaattccccgaggagggcgcaacatgtttgcagctaccccaccgatgttgtgtgcaagaaggggggcccaaaaaggaggacgggttataatacacgaagcacgcggccgcgccgtaataacaaacgcgtgtgacagcgggaaaaaaagagcgctccgtcggggagcactcgggagaacggaacaccatactcaggggggcgggcgaaccactgtgcggcaacacaagcaccccagagaggatatagagccccaacaggcgaacgatatacaaagtcagggcgacatatcgtcgttcaaaccacaggaatataacgtgccggagaaaatgtgcccaccgagcagactgatcgacacactttttacgg

SEQ ID NO: 458493 - DNA, 2668 bp, Homo sapiens
  misc_feature (1563)..(1563): n is a, c, g, or t
gctctgaacttggaggcagagacccaagcagctggaggctctgtgtgtgggtcgctgatttcttggagcctgaaaagaagcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccncctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacaatgtcacgggaccagtattgtttacccaattttttataaggacactgaagcttagaggagtgaaatgttttgagtgttatttcagagagcaaatggcaaagactggatccaaacccatcttcctggacctgaagttcatgctcccagccaccccacccctgagctgaataaagatgatttaagcataaaaaaaaaaaaaaaaaaaaaaagattaaaaggaaaaagaactcaattacaaacaaaaaaaaaagggggggcggcgccctgaagaaattccccgaggagggcgcaacatgtttgcagctaccccaccgatgttgtgtgcaagaaggggggcccaaaaaggaggacgggttataatacacgaagcacgcggccgcgccgtaataacaaacgcgtgtgacagcgggaaaaaaagagcgctccgtcggggagcactcgggagaacggaacaccatactcaggggggcgggcgaaccactgtgcggcaacacaagcaccccagagaggatatagagccccaacaggcgaacgatatacaaagtcagggcgacatatcgtcgttcaaaccacaggaatataacgtgccggagaaaatgtgcccaccgagcagactgatcgacacactttttacgg

SEQ ID NO: 458494 - DNA, 2018 bp, Homo sapiens
gctctgaacttggaggcagagacccaagcagctggaggctctgtgtgtgggtcgctgatttcttggagcctgaaaagaagcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattcccctgatgggccctgactcttccccataatcactgaccagccttgacactccccttgcaaaccatcccagcactgcaccccaggcagccactcctagccttggcctttggcatgagatggaggcctccttattccccatctggtccagttccttcacttacagatggcagcagtgaggccttggggtagaaggatcctccaaagtcacacagagtgcctgcctcctggtcccctcagctctgcctctgcagcccactgcctgcccagtgccatcaggatgagcagtaccggccaagcataatgacagagagaggcagatttcagggaagccctgactgtgtggagctaaggacacagtggagattctctggcactctgaggtctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagtaactttctgctgatgaacaaatctgcaccccacttcagacctcggtgggcattcacaccaccccccatgccaccggctccactttccccttttattaatacattcacccagataatcattaaaattaacatgtgccaggtcttaggatgtgtcttggggtgggcacagtacccggtgactcttggggatatttatttattttccctgagcctatatcttcatctgtgaaatggggataaaaatacttgttgctgtcacaattattaccatctctccagctagcaaaattactaccagagccgttactacacacaaaggctattgaccgagcacataccatgtgccacacaccttgacaaaatcttttaatacagtttattatgtactattcaatctttacacattccacagggggccggtaccgagctgata

SEQ ID NO: 458495 - DNA, 1062 bp, Homo sapiens
gctctgaacttggaggcagagacccaagcagctggaggctctgtgtgtgggtcgctgatttcttggagcctgaaaagaagcaggagcagcgactggacccagagccatgtggctgtgccctctggccctcaacctcatcttgatggcagcctctggtgctgcgtgcgaagtgaaggacgtttgtgttggaagccctggtatccccggcactcctggatcccacggcctgccaggcagggacgggagagatggtgtcaaaggagaccctggccctccaggccccatgggtccgcctggagaaacaccatgtcctcctgggaataatgggctgcctggagcccctggtgtccctggagagcgtggagagaagggggaggctggcgagagaggccctccagggcttccagctcatctagatgaggagctccaagccacactccacgacttcagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagatgggacccctgtaaactacaccaactggtaccgaggggagcctgcaggtcggggaaaagagcagtgtgtggagatgtacacagatgggcagtggaatgacaggaactgcctgtactcccgactgaccatctgtgagttctgagaggcatttaggccatgggacagggaggatcctgtctggccttcagtttccatccccaggatccacttggtctgtgagatgctagaactccctttcaacagaattcacttgtggctattagagctggaggcacccttagccacttcattccccttttccagactggtgtcactcaggaatcaactagaccatatacgatcactgcccta

SEQ ID NO: 458496 - DNA, 550 bp, Homo sapiens
ggcgccagaggaccccgatatttgtggttctggccatagatgaatacacgggtaaaacttctacaggcacggtatatgttagagtacccgatttcaatgacaattgtccaacagctgtcctcgaaaaagatgcagtttgcagttcttcaccttccggggttgtctccgctagaacactgaataatagatacactggcccctatacatttgcactggaagatcaacctgtaaagttgcctgccgtatggagtatcacaaccctcaatgctacctcggccctcctcagagcccaggaacagatacctcctggagtataccacatctccctggtacttacagacagccagaaccacaaatatcggcgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacccgccaa

SEQ ID NO: 458497 - DNA, 353 bp, Homo sapiens
ttttcttagacattaactgcagacggctggcaggatagaagcagcggctcacttggactttttcaccagggaaatcagagacaatgatggggctcttccccagaactacaggggctctggccatcttcgtggtggtcatattggttcatggagaattgcgaatagagactaaaggtcaatatgatgaagaagagatgactatgcaacaagctaaaagaaggcaaaaacgtgaatgggtgaaatttgccaaaccctgcagagaaggagaagataactcaaaaagaaacccaattgccaagattacttcagattaccaagcaacccagaaaatctacagtgggcggggccgagcc

SEQ ID NO: 458498 - DNA, 5535 bp, Homo sapiens
ttttcttagacattaactgcagacggctggcaggatagaagcagcggctcacttggactttttcaccagggaaatcagagacaatgatggggctcttccccagaactacaggggctctggccatcttcgtggtggtcatattggttcatggagaattgcgaatagagactaaaggtcaatatgatgaagaagagatgactatgcaacaagctaaaagaaggcaaaaacgtgaatgggtgaaatttgccaaaccctgcagagaaggagaagataactcaaaaagaaacccaattgccaagattacttcagattaccaagcaacccagaaaatcacctaccgaatctctggagtgggaatcgatcagccgccttttggaatctttgttgttgacaaaaacactggagatattaacataacagctatagtcgaccgggaggaaactccaagcttcctgatcacatgtcgggctctaaatgcccaaggactagatgtagagaaaccacttatactaacggttaaaattttggatattaatgataatcctccagtattttcacaacaaattttcatgggtgaaattgaagaaaatagtgcctcaaactcactggtgatgatactaaatgccacagatgcagatgaaccaaaccacttgaattctaaaattgccttcaaaattgtctctcaggaaccagcaggcacacccatgttcctcctaagcagaaacactggggaagtccgtactttgaccaattctcttgaccgagagcaagctagcagctatcgtctggttgtgagtggtgcagacaaagatggagaaggactatcaactcaatgtgaatgtaatattaaagtgaaagatgtcaacgataacttcccaatgtttagagactctcagtattcagcacgtattgaagaaaatattttaagttctgaattacttcgatttcaagtaacagatttggatgaagagtacacagataattggcttgcagtatatttctttacctctgggaatgaaggaaattggtttgaaatacaaactgatcctagaactaatgaaggcatcctgaaagtggtgaaggctctagattatgaacaactacaaagcgtgaaacttagtattgctgtcaaaaacaaagctgaatttcaccaatcagttatctctcgataccgagttcagtcaaccccagtcacaattcaggtaataaatgtaagagaaggaattgcattccgtcctgcttccaagacatttactgtgcaaaaaggcataagtagcaaaaaattggtggattatatcctgggaacatatcaagccatcgatgaggacactaacaaagctgcctcaaatgtcaaatatgtcatgggacgtaacgatggtggatacctaatgattgattcaaaaactgctgaaatcaaatttgtcaaaaatatgaaccgagattctactttcatagttaacaaaacaatcacagctgaggttctggccatagatgaatacacgggtaaaacttctacaggcacggtatatgttagagtacccgatttcaatgacaattgtccaacagctgtcctcgaaaaagatgcagtttgcagttcttcaccttccggggttgtctccgctagaacactgaataatagatacactggcccctatacatttgcactggaagatcaacctgtaaagttgcctgccgtatggagtatcacaaccctcaatgctacctcggccctcctcagagcccaggaacagatacctcctggagtataccacatctccctggtacttacagacagccagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgttggccccccttctgctgttgacctgtgactgtggggcaggttctactgggggagtgacaggtggttttatcccagttcctgatggctcagaaggaacaattcatcagtggggaattgaaggagcccatcctgaagacaaggaaatcacaaatatttgtgtgcctcctgtaacagccaatggagccgatttcatggaaagttctgaagtttgtacaaatacgtatgccagaggcacagcggtggaaggcacttcaggaatggaaatgaccactaagcttggagcagccactgaatctggaggtgctgcaggctttgcaacagggacagtgtcaggagctgcttcaggattcggagcagccactggagttggcatctgttcctcagggcagtctggaaccatgagaacaaggcattccactggaggaaccaataaggactacgctgatggggcgataagcatgaattttctggactcctacttttctcagaaagcatttgcctgtgcggaggaagacgatggccaggaagcaaatgactgcttgttgatctatgataatgaaggcgcagatgccactggttctcctgtgggctccgtgggttgttgcagttttattgctgatgacctggatgacagcttcttggactcacttggacccaaatttaaaaaacttgcagagataagccttggtgttgatggtgaaggcaaagaagttcagccaccctctaaagacagcggttatgggattgaatcctgtggccatcccatagaagtccagcagacaggatttgttaagtgccagactttgtcaggaagtcaaggagcttctgctttgtccgcctctgggtctgtccagccagctgtttccatccctgaccctctgcagcatggtaactatttagtaacggagacttactcggcttctggttccctcgtgcaaccttccactgcaggctttgatccacttctcacacaaaatgtgatagtgacagaaagggtgatctgtcccatttccagtgttcctggcaacctagctggcccaacgcagctacgagggtcacatactatgctctgtacagaggatccttgctcccgtctaatatgaccagaatgagctggaataccacactgaccaaatctggatctttggactaaagtattcaaaatagcatagcaaagctcactgtattgggctaataatttggcacttattagcttctctcataaactgatcacgattataaattaaatgtttgggttcataccccaaaagcaatatgttgtcactcctaattctcaagtactattcaaattgtagtaaatcttaaagtttttcaaaaccctaaaatcatattcgccaggaaattttcctaaacattcttaagcttctatttttcccctgccaaaggaaggtgtttatcattttaaaatgcaatgtgatttagtggattaagcaggagcgctggttcttgtctccattgccttttcttatatcattgataatgatgtaagaatcacaaggggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcatgaacccgggaagcggagcttgcagtgagccgagattgcgccactgcagtccgcagtccggcctgggcgacagagcgagactccgtctcaaaaaaaaaaaaaaaaaaagaatcacaaggtatttgctaaagcattttgagctgcttggaaaaagggaagtagttgcagtagagtttcttccatcttcttggtgctgggaagccatatatgtgtcttttactcaagctaaggggtataagcttatgtgttgaatttgctacatctatatttcacatattctcacaataagagaattttgaaatagaaatatcatagaacatttaagaaagtttagtataaataatattttgtgtgttttaatccctttgaagggatctatccaaagaaaatattttacactgagctccttcctacacgtctcagtaacagatcctgtgttagtctttgaaaatagctcattttttaaatgtcagtgagtagatgtagcatacatatgatgtataatgacgtgtattatgttaacaatgtctgcagattttgtaggaatacaaaacatggccttttttataagcaaaacgggccaatgactagaataacacatagggcaatctgtgaatatgtattataagcagcattccagaaaagtagttggtgaaataattttcaagtcaaaaagggatatggaaagggaattatgagtaacctctattttttaagccttgcttttaaattaaacagctacagccatttaagccttgaggataataaagcttgagagtaataatgttaggttagcaaaggtttagatgtatcacttcatgcatgctaccatgatagtaatgcagctcttcgagtcatttctggtcattcaagatattcacccttttgcccatagaaagcaccctacctcacctgcttactgacattgtcttagctgatcacaagatcattatcagcctccattattccttactgtatataaaatacagagttttatattttcctttcttcgtttttcaccatattcaaaacctaaatttgtttttgcagatggaatgcaaagtaatcaagtgtttgtgctttcacctagaagggtgtggtcctgaaggaaagaggtcccctaaatatcccccaccctggtgctcctccctctccctggtaccctgactaccaggaagtcaggtgctagagcagctggagaagtgcaggcagcctgtgcttccacagatgggggtgctgctgcaacaaggctttcaatgtgcccatcttaggtgggagaagctagatcctgtgcagcagcctggtaagtcctgaggaggttccattgctcttcctgctgctgtcctttgcttctcaacggtggctcgctctacagtctagagcacatgcagctaacttgtgcctctgcttatgcatgagggttaaattaacaaccataaccttcatttgaagttcaaaggtgtattcaggatcctcaaagcattttaaccttgccgcttaaaacccaatttaccgtgaaatgggaattttgctgcattgttaaactgtagtggaaaccatgctatagtaataaaggttatataagagagaaattgaaattaaatgtgtttttaaatttcaaaaaaaaatcaatctttaggatgacttaaaaattgatttgccatgtaaaatgtatctgcattttttacacaaaacttgttttaagcataaaattttaaaactgtactacttgatgtattatacattttgaaccatatgtattaaaccataaacagtataatgttgttataataaaacaggcaataaatttataaataaaagctgaactactctcta

SEQ ID NO: 458499 - DNA, 3477 bp, Homo sapiens
ttttcttagacattaactgcagacggctggcaggatagaagcagcggctcacttggactttttcaccagggaaatcagagacaatgatggggctcttccccagaactacaggggctctggccatcttcgtggtggtcatattggttcatggagaattgcgaatagagactaaaggtcaatatgatgaagaagagatgactatgcaacaagctaaaagaaggcaaaaacgtgaatgggtgaaatttgccaaaccctgcagagaaggagaagataactcaaaaagaaacccaattgccaagattacttcagattaccaagcaacccagaaaatcacctaccgaatctctggagtgggaatcgatcagccgccttttggaatctttgttgttgacaaaaacactggagatattaacataacagctatagtcgaccgggaggaaactccaagcttcctgatcacatgtcgggctctaaatgcccaaggactagatgtagagaaaccacttatactaacggttaaaattttggatattaatgataatcctccagtattttcacaacaaattttcatgggtgaaattgaagaaaatagtgcctcaaactcactggtgatgatactaaatgccacagatgcagatgaaccaaaccacttgaattctaaaattgccttcaaaattgtctctcaggaaccagcaggcacacccatgttcctcctaagcagaaacactggggaagtccgtactttgaccaattctcttgaccgagagcaagctagcagctatcgtctggttgtgagtggtgcagacaaagatggagaaggactatcaactcaatgtgaatgtaatattaaagtgaaagatgtcaacgataacttcccaatgtttagagactctcagtattcagcacgtattgaagaaaatattttaagttctgaattacttcgatttcaagtaacagatttggatgaagagtacacagataattggcttgcagtatatttctttacctctgggaatgaaggaaattggtttgaaatacaaactgatcctagaactaatgaaggcatcctgaaagtggtgaaggctctagattatgaacaactacaaagcgtgaaacttagtattgctgtcaaaaacaaagctgaatttcaccaatcagttatctctcgataccgagttcagtcaaccccagtcacaattcaggtaataaatgtaagagaaggaattgcattccgtcctgcttccaagacatttactgtgcaaaaaggcataagtagcaaaaaattggtggattatatcctgggaacatatcaagccatcgatgaggacactaacaaagctgcctcaaatgtcaaatatgtcatgggacgtaacgatggtggatacctaatgattgattcaaaaactgctgaaatcaaatttgtcaaaaatatgaaccgagattctactttcatagttaacaaaacaatcacagctgaggttctggccatagatgaatacacgggtaaaacttctacaggcacggtatatgttagagtacccgatttcaatgacaattgtccaacagctgtcctcgaaaaagatgcagtttgcagttcttcaccttccggggttgtctccgctagaacactgaataatagatacactggcccctatacatttgcactggaagatcaacctgtaaagttgcctgccgtatggagtatcacaaccctcaatgctacctcggccctcctcagagcccaggaacagatacctcctggagtataccacatctccctggtacttacagacagccagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgttggccccccttctgctgttgacctgtgactgtggggcaggttctactgggggagtgacaggtggttttatcccagttcctgatggctcagaaggaacaattcatcagtggggaattgaaggagcccatcctgaagacaaggaaatcacaaatatttgtgtgcctcctgtaacagccaatggagccgatttcatggaaagttctgaagtttgtacaaatacgtatgccagaggcacagcggtggaaggcacttcaggaatggaaatgaccactaagcttggagcagccactgaatctggaggtgctgcaggctttgcaacagggacagtgtcaggagctgcttcaggattcggagcagccactggagttggcatctgttcctcagggcagtctggaaccatgagaacaaggcattccactggaggaaccaataaggactacgctgatggggcgataagcatgaattttctggactcctacttttctcagaaagcatttgcctgtgcggaggaagacgatggccaggaagcaaatgactgcttgttgatctatgataatgaaggcgcagatgccactggttctcctgtgggctccgtgggttgttgcagttttattgctgatgacctggatgacagcttcttggactcacttggacccaaatttaaaaaacttgcagagataagccttggtgttgatggtgaaggcaaagaagttcagccaccctctaaagacagcggttatgggattgaatcctgtggccatcccatagaagtccagcagacaggatttgttaagtgccagactttgtcaggaagtcaaggagcttctgctttgtccgcctctgggtctgtccagccagctgtttccatccctgaccctctgcagcatggtaactatttagtaacggagacttactcggcttctggttccctcgtgcaaccttccactgcaggctttgatccacttctcacacaaaatgtgatagtgacagaaagggtgatctgtcccatttccagtgttcctggcaacctagctggcccaacgcagctacgagggtcacatactatgctctgtacagaggatccttgctcccgtctaatatgaccagaatgagctggaataccacactgaccaaatctggatctttggactaaagtattcaaaatagcatagcaaagctcactgtattgggctaataatttggcacttattagcttctctcataaactgatcacgattataaattaaatgtttgggttcataccccaaaagcaatatgttgtcactcctaattctcaagtactattcaaattgtagtaaatcttaaagtttttcaaaaccctaaaatcatattcgccaggaaattttcctaaacattcttaagcttctatttttcccctgccaaaggaaggtgtttatcattttaaaatgcaatgtgatttagtggataaccttctctcatgacaagttcactctggaacagctagaccagatacgg

SEQ ID NO: 458500 - DNA, 4192 bp, Homo sapiens
gtctctgatccctcatgggttctgcctgcccttgtatctcttgtacaatgctcccaaagggctttgctgatctctgcacttctttcctgggacactccccccaccaccaccctttgcacacaccagtgaccaaagtgtatgcagtgatctcacagaagacatcaaaaatggtgcatgcaccgtgaatgtgctcacagaggcacgtgcacaagattctgcacccttggccttaatctcagtatgacttaaggtgcaggaacatttttaacaggttttaaaaaaacaaaaaacccttctgggaggaaaaaaataaaaagcagatacaacagctcaactgttcccactcctaactctccactatgtgcttataacttcactacctcggccctcctcagagcccaggaacagatacctcctggagtataccacatctccctggtacttacagacagccagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgttggccccccttctgctgttgacctgtgactgtggggcaggttctactgggggagtgacaggtggttttatcccagttcctgatggctcagaaggaacaattcatcagtggggaattgaaggagcccatcctgaagacaaggaaatcacaaatatttgtgtgcctcctgtaacagccaatggagccgatttcatggaaagttctgaagtttgtacaaatacgtatgccagaggcacagcggtggaaggcacttcaggaatggaaatgaccactaagcttggagcagccactgaatctggaggtgctgcaggctttgcaacagggacagtgtcaggagctgcttcaggattcggagcagccactggagttggcatctgttcctcagggcagtctggaaccatgagaacaaggcattccactggaggaaccaataaggactacgctgatggggcgataagcatgaattttctggactcctacttttctcagaaagcatttgcctgtgcggaggaagacgatggccaggaagcaaatgactgcttgttgatctatgataatgaaggcgcagatgccactggttctcctgtgggctccgtgggttgttgcagttttattgctgatgacctggatgacagcttcttggactcacttggacccaaatttaaaaaacttgcagagataagccttggtgttgatggtgaaggcaaagaagttcagccaccctctaaagacagcggttatgggattgaatcctgtggccatcccatagaagtccagcagacaggatttgttaagtgccagactttgtcaggaagtcaaggagcttctgctttgtccgcctctgggtctgtccagccagctgtttccatccctgaccctctgcagcatggtaactatttagtaacggagacttactcggcttctggttccctcgtgcaaccttccactgcaggctttgatccacttctcacacaaaatgtgatagtgacagaaagggtgatctgtcccatttccagtgttcctggcaacctagctggcccaacgcagctacgagggtcacatactatgctctgtacagaggatccttgctcccgtctaatatgaccagaatgagctggaataccacactgaccaaatctggatctttggactaaagtattcaaaatagcatagcaaagctcactgtattgggctaataatttggcacttattagcttctctcataaactgatcacgattataaattaaatgtttgggttcataccccaaaagcaatatgttgtcactcctaattctcaagtactattcaaattgtagtaaatcttaaagtttttcaaaaccctaaaatcatattcgccaggaaattttcctaaacattcttaagcttctatttttcccctgccaaaggaaggtgtttatcattttaaaatgcaatgtgatttagtggattaagcaggagcgctggttcttgtctccattgccttttcttatatcattgataatgatgtaagaatcacaaggggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcatgaacccgggaagcggagcttgcagtgagccgagattgcgccactgcagtccgcagtccggcctgggcgacagagcgagactccgtctcaaaaaaaaaaaaaaaaaaagaatcacaaggtatttgctaaagcattttgagctgcttggaaaaagggaagtagttgcagtagagtttcttccatcttcttggtgctgggaagccatatatgtgtcttttactcaagctaaggggtataagcttatgtgttgaatttgctacatctatatttcacatattctcacaataagagaattttgaaatagaaatatcatagaacatttaagaaagtttagtataaataatattttgtgtgttttaatccctttgaagggatctatccaaagaaaatattttacactgagctccttcctacacgtctcagtaacagatcctgtgttagtctttgaaaatagctcattttttaaatgtcagtgagtagatgtagcatacatatgatgtataatgacgtgtattatgttaacaatgtctgcagattttgtaggaatacaaaacatggccttttttataagcaaaacgggccaatgactagaataacacatagggcaatctgtgaatatgtattataagcagcattccagaaaagtagttggtgaaataattttcaagtcaaaaagggatatggaaagggaattatgagtaacctctattttttaagccttgcttttaaattaaacagctacagccatttaagccttgaggataataaagcttgagagtaataatgttaggttagcaaaggtttagatgtatcacttcatgcatgctaccatgatagtaatgcagctcttcgagtcatttctggtcattcaagatattcacccttttgcccatagaaagcaccctacctcacctgcttactgacattgtcttagctgatcacaagatcattatcagcctccattattccttactgtatataaaatacagagttttatattttcctttcttcgtttttcaccatattcaaaacctaaatttgtttttgcagatggaatgcaaagtaatcaagtgtttgtgctttcacctagaagggtgtggtcctgaaggaaagaggtcccctaaatatcccccaccctggtgctcctccctctccctggtaccctgactaccaggaagtcaggtgctagagcagctggagaagtgcaggcagcctgtgcttccacagatgggggtgctgctgcaacaaggctttcaatgtgcccatcttaggtgggagaagctagatcctgtgcagcagcctggtaagtcctgaggaggttccattgctcttcctgctgctgtcctttgcttctcaacggtggctcgctctacagtctagagcacatgcagctaacttgtgcctctgcttatgcatgagggttaaattaacaaccataaccttcatttgaagttcaaaggtgtattcaggatcctcaaagcattttaaccttgccgcttaaaacccaatttaccgtgaaatgggaattttgctgcattgttaaactgtagtggaaaccatgctatagtaataaaggttatataagagagaaattgaaattaaatgtgtttttaaatttcaaaaaaaaatcaatctttaggatgacttaaaaattgatttgccatgtaaaatgtatctgcattttttacacaaaacttgttttaagcataaaattttaaaactgtactacttgatgtattatacattttgaaccatatgtattaaaccataaacagtataatgttgttataataaaacaggcaataaatttataaataaaagctgaactactctcta

SEQ ID NO: 458501 - DNA, 605 bp, Homo sapiens
ggagagaataattggcctacctgcaacagagaggacaaggaggcaggtgtagacagatttacccacttgaacccattatagccctcatcactgctcaaacatcactctattatcaaccctattgtttgtggcaactaactctgctaatgaaaataagtagtaagagtgtaagacactgctgtggttggaataggtcttccaaagctcatgtgttgaaaacttaatccccactgcagtagtgttgagaggtgagacctgtaagaggaaatgaggtcatgagagctctgtcctcatgcatggattaatggtgttaccatgggagtgggttcattacagtaagagtgagttgttataagggtgagttcagcccccacgtgctctcatgctctcttgtccttccaccttccaccgtgggatgatgaagtccaaaggcctttgtcagattctgacaccttgatattgagcttcccaaccttcaaaactgtgagaaataaatgtgttttctttatgaattatccagtctgtgatattctgttatagcaacacaaaatagactgaaaagacacttcgtcctactgttgatttgcatgattctttctctacag

SEQ ID NO: 458502 - DNA, 348 bp, Homo sapiens
cctgtcttttctatttctggctgttgtcactgaaaatcttatttctttgtacacttttaaaattagtatatttttagagctttttcacccgtttatatgccctcctttgtgactctcacataacacattgtgggatgttatcacctctagtcatataattgtattttctcccacttacttgtttgcatggtgactgcttatagacacccaagacccattttataaaaatgcaacaaacaacagcataagatattacagaatgttctcccttgtttttagaagtttgtacaaatacgtatgccagaggcacagcggtggaaggcacttcaggaatggaaatgaccacta

SEQ ID NO: 458503 - DNA, 461 bp, Homo sapiens
ggcgccagaggaccccgatatttgtggttctggccatagatgaatacacgggtaaaacttctacaggcacggtatatgttagagtacccgatttcaatgacaattgtccaacagctgtcctcgaaaaagatgcagtttgcagttcttcaccttccggggttgtctccgctagaacactgaataatagatacactggcccctatacatttgcactggaagatcaacctgtaaagttgcctgccgtatggagtatcacaaccctcaatgctacctcggccctcctcagagcccaggaacagatacctcctggagtataccacatctccctggtacttacagacagccagaacacaaatatcgggccggggacatcttcctcctcatcttcctccttgtcctcctcatcctcctcatcctcatctttgtcctcatcatcctgaccatggccagaccacaaatag

SEQ ID NO: 458504 - DNA, 4083 bp, Homo sapiens
ggcgccagaggaccccgatatttgtggttctggccatagatgaatacacgggtaaaacttctacaggcacggtatatgttagagtacccgatttcaatgacaattgtccaacagctgtcctcgaaaaagatgcagtttgcagttcttcaccttccggggttgtctccgctagaacactgaataatagatacactggcccctatacatttgcactggaagatcaacctgtaaagttgcctgccgtatggagtatcacaaccctcaatgctacctcggccctcctcagagcccaggaacagatacctcctggagtataccacatctccctggtacttacagacagccagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgttggccccccttctgctgttgacctgtgactgtggggcaggttctactgggggagtgacaggtggttttatcccagttcctgatggctcagaaggaacaattcatcagtggggaattgaaggagcccatcctgaagacaaggaaatcacaaatatttgtgtgcctcctgtaacagccaatggagccgatttcatggaaagttctgaagtttgtacaaatacgtatgccagaggcacagcggtggaaggcacttcaggaatggaaatgaccactaagcttggagcagccactgaatctggaggtgctgcaggctttgcaacagggacagtgtcaggagctgcttcaggattcggagcagccactggagttggcatctgttcctcagggcagtctggaaccatgagaacaaggcattccactggaggaaccaataaggactacgctgatggggcgataagcatgaattttctggactcctacttttctcagaaagcatttgcctgtgcggaggaagacgatggccaggaagcaaatgactgcttgttgatctatgataatgaaggcgcagatgccactggttctcctgtgggctccgtgggttgttgcagttttattgctgatgacctggatgacagcttcttggactcacttggacccaaatttaaaaaacttgcagagataagccttggtgttgatggtgaaggcaaagaagttcagccaccctctaaagacagcggttatgggattgaatcctgtggccatcccatagaagtccagcagacaggatttgttaagtgccagactttgtcaggaagtcaaggagcttctgctttgtccgcctctgggtctgtccagccagctgtttccatccctgaccctctgcagcatggtaactatttagtaacggagacttactcggcttctggttccctcgtgcaaccttccactgcaggctttgatccacttctcacacaaaatgtgatagtgacagaaagggtgatctgtcccatttccagtgttcctggcaacctagctggcccaacgcagctacgagggtcacatactatgctctgtacagaggatccttgctcccgtctaatatgaccagaatgagctggaataccacactgaccaaatctggatctttggactaaagtattcaaaatagcatagcaaagctcactgtattgggctaataatttggcacttattagcttctctcataaactgatcacgattataaattaaatgtttgggttcataccccaaaagcaatatgttgtcactcctaattctcaagtactattcaaattgtagtaaatcttaaagtttttcaaaaccctaaaatcatattcgccaggaaattttcctaaacattcttaagcttctatttttcccctgccaaaggaaggtgtttatcattttaaaatgcaatgtgatttagtggattaagcaggagcgctggttcttgtctccattgccttttcttatatcattgataatgatgtaagaatcacaaggggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcatgaacccgggaagcggagcttgcagtgagccgagattgcgccactgcagtccgcagtccggcctgggcgacagagcgagactccgtctcaaaaaaaaaaaaaaaaaaagaatcacaaggtatttgctaaagcattttgagctgcttggaaaaagggaagtagttgcagtagagtttcttccatcttcttggtgctgggaagccatatatgtgtcttttactcaagctaaggggtataagcttatgtgttgaatttgctacatctatatttcacatattctcacaataagagaattttgaaatagaaatatcatagaacatttaagaaagtttagtataaataatattttgtgtgttttaatccctttgaagggatctatccaaagaaaatattttacactgagctccttcctacacgtctcagtaacagatcctgtgttagtctttgaaaatagctcattttttaaatgtcagtgagtagatgtagcatacatatgatgtataatgacgtgtattatgttaacaatgtctgcagattttgtaggaatacaaaacatggccttttttataagcaaaacgggccaatgactagaataacacatagggcaatctgtgaatatgtattataagcagcattccagaaaagtagttggtgaaataattttcaagtcaaaaagggatatggaaagggaattatgagtaacctctattttttaagccttgcttttaaattaaacagctacagccatttaagccttgaggataataaagcttgagagtaataatgttaggttagcaaaggtttagatgtatcacttcatgcatgctaccatgatagtaatgcagctcttcgagtcatttctggtcattcaagatattcacccttttgcccatagaaagcaccctacctcacctgcttactgacattgtcttagctgatcacaagatcattatcagcctccattattccttactgtatataaaatacagagttttatattttcctttcttcgtttttcaccatattcaaaacctaaatttgtttttgcagatggaatgcaaagtaatcaagtgtttgtgctttcacctagaagggtgtggtcctgaaggaaagaggtcccctaaatatcccccaccctggtgctcctccctctccctggtaccctgactaccaggaagtcaggtgctagagcagctggagaagtgcaggcagcctgtgcttccacagatgggggtgctgctgcaacaaggctttcaatgtgcccatcttaggtgggagaagctagatcctgtgcagcagcctggtaagtcctgaggaggttccattgctcttcctgctgctgtcctttgcttctcaacggtggctcgctctacagtctagagcacatgcagctaacttgtgcctctgcttatgcatgagggttaaattaacaaccataaccttcatttgaagttcaaaggtgtattcaggatcctcaaagcattttaaccttgccgcttaaaacccaatttaccgtgaaatgggaattttgctgcattgttaaactgtagtggaaaccatgctatagtaataaaggttatataagagagaaattgaaattaaatgtgtttttaaatttcaaaaaaaaatcaatctttaggatgacttaaaaattgatttgccatgtaaaatgtatctgcattttttacacaaaacttgttttaagcataaaattttaaaactgtactacttgatgtattatacattttgaaccatatgtattaaaccataaacagtataatgttgttataataaaacaggcaataaatttataaataaaagctgaactactctcta

SEQ ID NO: 458505 - DNA, 2819 bp, Homo sapiens
ttttcttagacattaactgcagacggctggcaggatagaagcagcggctcacttggactttttcaccagggaaatcagagacaatgatggggctcttccccagaactacaggggctctggccatcttcgtggtggtcatattggttcatggagaattgcgaatagagactaaaggtcaatatgatgaagaagagatgactatgcaacaagctaaaagaaggcaaaaacgtgaatgggtgaaatttgccaaaccctgcagagaaggagaagataactcaaaaagaaacccaattgccaagattacttcagattaccaagcaacccagaaaatcacctaccgaatctctggagtgggaatcgatcagccgccttttggaatctttgttgttgacaaaaacactggagatattaacataacagctatagtcgaccgggaggaaactccaagcttcctgatcacatgtcgggctctaaatgcccaaggactagatgtagagaaaccacttatactaacggttaaaattttggatattaatgataatcctccagtattttcacaacaaattttcatgggtgaaattgaagaaaatagtgcctcaaactcactggtgatgatactaaatgccacagatgcagatgaaccaaaccacttgaattctaaaattgccttcaaaattgtctctcaggaaccagcaggcacacccatgttcctcctaagcagaaacactggggaagtccgtactttgaccaattctcttgaccgagagcaagctagcagctatcgtctggttgtgagtggtgcagacaaagatggagaaggactatcaactcaatgtgaatgtaatattaaagtgaaagatgtcaacgataacttcccaatgtttagagactctcagtattcagcacgtattgaagaaaatattttaagttctgaattacttcgatttcaagtaacagatttggatgaagagtacacagataattggcttgcagtatatttctttacctctgggaatgaaggaaattggtttgaaatacaaactgatcctagaactaatgaaggcatcctgaaagtggtgaaggctctagattatgaacaactacaaagcgtgaaacttagtattgctgtcaaaaacaaagctgaatttcaccaatcagttatctctcgataccgagttcagtcaaccccagtcacaattcaggtaataaatgtaagagaaggaattgcattccgtcctgcttccaagacatttactgtgcaaaaaggcataagtagcaaaaaattggtggattatatcctgggaacatatcaagccatcgatgaggacactaacaaagctgcctcaaatgtcaaatatgtcatgggacgtaacgatggtggatacctaatgattgattcaaaaactgctgaaatcaaatttgtcaaaaatatgaaccgagattctactttcatagttaacaaaacaatcacagctgaggttctggccatagatgaatacacgggtaaaacttctacaggcacggtatatgttagagtacccgatttcaatgacaattgtccaacagctgtcctcgaaaaagatgcagtttgcagttcttcaccttccggggttgtctccgctagaacactgaataatagatacactggcccctatacatttgcactggaagatcaacctgtaaagttgcctgccgtatggagtatcacaaccctcaatgctacctcggccctcctcagagcccaggaacagatacctcctggagtataccacatctccctggtacttacagacagccagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgttggccccccttctgctgttgacctgtgactgtggggcaggttctactgggggagtgacaggtggttttatcccagttcctgatggctcagaaggaacaattcatcagtggggaattgaaggagcccatcctgaagacaaggaaatcacaaatatttgtgtgcctcctgtaacagccaatggagccgatttcatggaaagttctgaagtttgtacaaatacgtatgccagaggcacagcggtggaaggcacttcaggaatggaaatgaccactaagcttggagcagccactgaatctggaggtgctgcaggctttgcaacagggacagtgtcaggagctgcttcaggattcggagcagccactggagttggcatctgttcctcagggcagtctggaaccatgagaacaaggcattccactggaggaaccaataaggactacgctgatggggcgataagcatgaattttctggactcctacttttctcagaaagcatttgcctgtgcggaggaagacgatggccaggaagcaaatgactgcttgttgatctatgataatgaaggcgcagatgccactggttctcctgtgggctccgtgggttgttgcagttttattgctgatgacctggatgacagcttcttggactcacttggacccaaatttaaaaaacttgcagagataagccttggtgttgatggtgaaggcaaagaagttcagccaccctctaaagacagcggttatgggattgaatcctgtggccatcccatagaagtccagcagacactttgaaggtgagggggaatggaatggtgaaaggcaaaaagaaataaggaccggtca

SEQ ID NO: 458506 - DNA, 2676 bp, Homo sapiens
gcgtctgctgcagcggccgcggtggctgaggaggcccgagaggagtcggtggcagcggcggcggcgggaccggcagcagcagcagcagcagcagcagcaaccactagcctcctgccccgcggcgctgccgcacgagccccacgagccgctcaccccgccgttctcagcgctgcccgaccccgctggcgcgccctcccgccgccagtcccggcagcgccctcagttgtcctccgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggatgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaatgcacaaacaatgcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatggggaggggcattgctgactgtgtatataggataattatgaaaagcagttctggatggtgtgccttccagatcctctctggggctgtgttttgagcagcaggtagcctgctggttttatctgagtgaaatactgtacaggggaataaaagagatcttatttttttttttatacttggcgttttttgaataaaaaccttttgtcttaa

SEQ ID NO: 458507 - DNA, 1999 bp, Homo sapiens
gaggaaagggtgtgggtgtctgctcctgcttgcatcgggtggggaggaaggcctcccaaagggcaccctgacttaggatgttgtgcaagcatccttgcttggatcctgtcggccatgagaatctcacccgggctcctgggcagtggtgaatgcaatttaaggatagtctatgagatacctttcttggttgtgcagacatgcatcccttcatccttcgcaggcggtcctgcctcacagggcctcaagttttgggtctgcggccagctgtgtttgtttcttggagcagttcataaagaatttcagtttatggtttgggctagcagagagggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaatgcacaaacaatgcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatggggaggggcattgctgactgtgtatataggataattatgaaaagcagttctggatggtgtgccttccagatcctctctggggctgtgttttgagcagcaggtagcctgctggttttatctgagtgaaatactgtacaggggaataaaagagatcttatttttttttttatacttggcgttttttgaataaaaaccttttgtcttaa

SEQ ID NO: 458508 - DNA, 1817 bp, Homo sapiens
gaggaaagggtgtgggtgtctgctcctgcttgcatcgggtggggaggaaggcctcccaaagggcaccctgacttaggatgttgtgcaagcatccttgcttggatcctgtcggccatgagaatctcacccgggctcctgggcagtgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaatgcacaaacaatgcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatggggaggggcattgctgactgtgtatataggataattatgaaaagcagttctggatggtgtgccttccagatcctctctggggctgtgttttgagcagcaggtagcctgctggttttatctgagtgaaatactgtacaggggaataaaagagatcttatttttttttttatacttggcgttttttgaataaaaaccttttgtcttaa

SEQ ID NO: 458509 - DNA, 1624 bp, Homo sapiens
tgttctagaaaatgcttggcctccctgggaccccagacttgtgggcctctgagaagcaaatggggaagacctttgcagtgtaaaaacaagttgagtcattcataacctcgtctatcctcctttctgcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaatgcacaaacaatgcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatggggaggggcattgctgactgtgtatataggataattatgaaaagcagttctggatggtgtgccttccagatcctctctggggctgtgttttgagcagcaggtagcctgctggttttatctgagtgaaatactgtacaggggaataaaagagatcttatttttttttttatacttggcgttttttgaataaaaaccttttgtcttaa

SEQ ID NO: 458510 - DNA, 2620 bp, Homo sapiens
gcgtctgctgcagcggccgcggtggctgaggaggcccgagaggagtcggtggcagcggcggcggcgggaccggcagcagcagcagcagcagcagcagcaaccactagcctcctgccccgcggcgctgccgcacgagccccacgagccgctcaccccgccgttctcagcgctgcccgaccccgctggcgcgccctcccgccgccagtcccggcagcgccctcagttgtcctccgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggatgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaatgcacaaacaatgcaatcaacagaaaagctgtaaatgtgtgtacagttggcatggtagtatactgtttttgtttcttgttttgaaagatgcgcattctaacctggaggtcaatgttatgtatttatttatttatttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatggggaggggcattgctgactgtgtatataggataattatgaaaagcagttctggatggtgtgccttccagatcctctctggggctgtgttttgagcagcaggtagcctgctggttttatctgagtgaaatactgtacaggggaataaaagagatcttatttttttttttatacttggcgttttttgaataaaaaccttttgtcttaa

SEQ ID NO: 458511 - DNA, 2267 bp, Homo sapiens
gcgtctgctgcagcggccgcggtggctgaggaggcccgagaggagtcggtggcagcggcggcggcgggaccggcagcagcagcagcagcagcagcagcaaccactagcctcctgccccgcggcgctgccgcacgagccccacgagccgctcaccccgccgttctcagcgctgcccgaccccgctggcgcgccctcccgccgccagtcccggcagcgccctcagttgtcctccgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggatgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttactcagcatcatagaattcgaaacatggccaatcaatgcaatccacaacctaggtgactggagctaacgccacttaaggatcattacgcagctacctgggcgaatatatcatccatagcgattgatcctactccttccacttcatctgcgataccacttcctactaatttatgcttgctctcttattcgttcctcatttctcgcttaccattctcgcctttcgcgtcgagcattatctactgtctgccttccaccattgattgttactactactgcgctgtttc

SEQ ID NO: 458512 - DNA, 1366 bp, Homo sapiens
  misc_feature (1343)..(1343): n is a, c, g, or t
  misc_feature (1360)..(1360): n is a, c, g, or t
gcgtctgctgcagcggccgcggtggctgaggaggcccgagaggagtcggtggcagcggcggcggcgggaccggcagcagcagcagcagcagcagcagcaaccactagcctcctgccccgcggcgctgccgcacgagccccacgagccgctcaccccgccgttctcagcgctgcccgaccccgctggcgcgccctcccgccgccagtcccggcagcgccctcagttgtcctccgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggatgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcttgctctgggcctcgtcgcccacataggaatccttctgacccatgcccaccatcacgccctggtgcctggggcgccccacgatggaggggaagacggcccggggggcatcgtcgcccgcgaagccggccttgcacatgccggagccgntgtcgacgacgagcgcngcgata

SEQ ID NO: 458513 - DNA, 519 bp, Homo sapiens
ggcctcccaaagggcaccctgacttaggatgttgtgcaagcatccttgcttggatcctgtcggccatgagaatctcacccgggctcctgggcagtggtgaatgcaatttaaggatagtctatgagatacctttcttggttgtgcagacatgcatcccttcatccttcgcaggcggtcctgcctcacagggcctcaagttttgggtctgcggccagctgtgtttgtttcttggagcagttcataaagaatttcagtttatggtttgggctagcagagaggtgggtaatgctttgggttggagagatgccgtaaggtgcgcctccactctccttagcccagagggaaaaatggagttcacctagctcctgagagaagggattttttttttttttaaaagaaagagttatatataccacccagcttctttgtgcttgtttttgctaaaagtgtgttttctcttctattcccttggctcacagggacccgagtgtatagccctccagagtggatccgctacca

SEQ ID NO: 458514 - DNA, 378 bp, Homo sapiens
gttgtgggaaaggcccccactattgaagtttgaaaaccacaggtttaagaggggagtcagtttttagctgaaagcagactggaggacccagatattagtcaataccttcctattgaagggtacccagcacagtgttctagaaaatgcttggcctccctgggaccccagacttgtgggcctctgagaagcaaatggggaagacctttgcagtgtaaaaacaagttgagtcattcataacctcgtctatcctcctttctgcagaatgtcagcatctcattagatggtgcttggccctgagaccatcagataggccaaccttcgaagaaatccagaaccatccatggatgcaagatgttctcctgccccaggaaactgctg

SEQ ID NO: 458515 - DNA, 3179 bp, Homo sapiens
gcgtctgctgcagcggccgcggtggctgaggaggcccgagaggagtcggtggcagcggcggcggcgggaccggcagcagcagcagcagcagcagcagcaaccactagcctcctgccccgcggcgctgccgcacgagccccacgagccgctcaccccgccgttctcagcgctgcccgaccccgctggcgcgccctcccgccgccagtcccggcagcgccctcagttgtcctccgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggatgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaatgcacaaacaatgcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatggggaggggcattgctgactgtgtatataggataattatgaaaagcagttctggatggtgtgccttccagatcctctctggggctgtgttttgagcagcaggtagcctgctggttttatctgagtgaaatactgtacaggggaataaaagagatcttatttttttttttatacttggcgttttttgaataaaaaccttttgtcttaaaaaaaaaaaaaaaaaaaaaaaaaaaaaaaaaaaaaaaggggggaaaaaaaaaaaaaaaaaaaaaaaaaaattttgggggggggccggggccccaaaaagatttttaaaaacctgggggggcgggcgggggcggcccccaaagatggaaggatggaaacactcgcgcgtccacacactgcggggtcccacgaagaaagaaaatgcccggcggctcaccacacaggcgcgtcgtggggcgctttccccccaaaataaaaagagcccgcgcgcgcgggagccaaccgagcggcgtctctactagaacccacaccccaggagaggagcgccgtcggagagagccccacacagcaccgggccatcacaacagaagagcgcgcctccccgagaggaccgcccgataaaataaaaaataccccgcccgcccgtgagcgacccccgtccgacacccgcaagctccacgcccccagcgccacgacagcgcacgtcacagcagccccgaccac

SEQ ID NO: 458516 - DNA, 2345 bp, Homo sapiens
gcgtctgctgcagcggccgcggtggctgaggaggcccgagaggagtcggtggcagcggcggcggcgggaccggcagcagcagcagcagcagcagcagcaaccactagcctcctgccccgcggcgctgccgcacgagccccacgagccgctcaccccgccgttctcagcgctgcccgaccccgctggcgcgccctcccgccgccagtcccggcagcgccctcagttgtcctccgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggatgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcatagtgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaatgcacaaacaatgcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatggggaggggcattgctgactgtgtatataggataattatgaaaagcagttctggatggtgtgccttccagatcctctctggggctgtgttttgagcagcaggtagcctgctggttttatctgagtgaaatactgtacaggggaataaaagagatcttatttttttttttatacttggcgttttttgaataaaaaccttttgtcttaa

SEQ ID NO: 458517 - DNA, 2082 bp, Homo sapiens
gcgtctgctgcagcggccgcggtggctgaggaggcccgagaggagtcggtggcagcggcggcggcgggaccggcagcagcagcagcagcagcagcagcaaccactagcctcctgccccgcggcgctgccgcacgagccccacgagccgctcaccccgccgttctcagcgctgcccgaccccgctggcgcgccctcccgccgccagtcccggcagcgccctcagttgtcctccgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggatgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttctgcgcctccgtaccttaacctcttgtccaccgaaccagaccctctcacaccacacgcgctcccccaa

SEQ ID NO: 458518 - DNA, 1496 bp, Homo sapiens
gcgtctgctgcagcggccgcggtggctgaggaggcccgagaggagtcggtggcagcggcggcggcgggaccggcagcagcagcagcagcagcagcagcaaccactagcctcctgccccgcggcgctgccgcacgagccccacgagccgctcaccccgccgttctcagcgctgcccgaccccgctggcgcgccctcccgccgccagtcccggcagcgccctcagttgtcctccgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggatgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctctggggctgtgttttgagcagcaggtagcctgctggttttatctgagtgaaatactgtacaggggaataaaagagatcttatttttttttttatacttggcgttttttgaataaaaaccttttgtcttaa

SEQ ID NO: 458519 - DNA, 350 bp, Homo sapiens
  misc_feature (37)..(37): n is a, c, g, or t
gatttcggaacgagggagcagaggctgcttttattancacagatgtcttcgaccccacataagcaagtacacagatgatacagaagaagaccttgataatgaaataagccaactaatagactctcagccattcagcagcatatcagatgacttatttggcccatccgagtctgtgtagcagacaggtctatttaaactttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagctta

SEQ ID NO: 458520 - DNA, 5113 bp, Homo sapiens
gaggcgccggtcccggccccgctgccgccgccgccacaccggcccttcgggagcgtctgaggaggcgcgggccgctgcgggctcgggcgccgcagcgcgccggcccgagcccctggacgaggcccacggagccgctcgccccgacccagccgcccgatgtcctcaaaatggaggcagcgggggcggcggcgtgaagaaagcggcgctgtgggcgcgggagtaggggcccgggcggaggcggtggcgggatggggctgctgctcatgatcctggcgtcggccgtgctgggttccttcctcacgctcctcgcccagttcttcctgctgtaccgcagacagcccgagccgccggcggacgaggccgcccgcgcgggcgagggcttccgctacatcaagccagtgccgggcctgctcctaagggagtacctttatggcggcggccgggatgaggagccctccggagcggcccctgagggcggcgcgacccccaccgcggcccccgagacccccgccccgccgacgcgggagacttgctacttcctcaacgccaccatcctattcctgttccgggagttgcgggacaccgcgctgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtggaagacccgctgatcgacttcgaggtgcgctcgcagtttgaagggcggcccatgccccagctcacctccatcatcgtcaaccagctcaagaagatcatcaagcgcaagcacaccctaccgaattacaagatcaggtttaagccgttttttccataccagaccttgcaaggatttgaagaagatgaagagcatatccatatacaacaatgggcacttactgaaggccgtcttaaagttacgttgttagaatgtagcaggttactcatttttggatcctatgacagagaggcaaatgttcattgcacacttgagttaagcagtagtgtttgggaagaaaaacagaggagttctattaagacggttgaattaatggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtggtgtgaaaatcacatcaacactgcaagtgttgaagcttatcaagcaggctggtgactggtcctggtgtactatgggcctgttggccagagtaatcaaggtgcagtgctgcaagataactttggccagttggaagaaaactttttgtcaagctcatgccaatcgggttatgaagaggaagctgccgggttgacagtagatactgaaagtagagagctggattctgaatttgaagacttggcaagtgatgtcagagcacaaaatgagttcaaagatgaggcacaatcattaagtcatagtcccaaacgtgttccaacaacactttctattaaaccccttggagctatatcaccagttttaaaccgtaaattagctgtaggaagtcacccactaccaccgaaaattcagtccaaagatggaaataaacctccacccctaaaaacttctgagataacagacccagcacaagtgtcaaaaccaacccaaggatctgctttcaaaccacctgtgccaccacgaccacaagcgaaagttcctttgccttccgccgatgctccaaatcaggcagaaccagatgttctcgttgaaaagccagagaaggtggtgccacctcctcttgtagataaatctgctgaaaagcaagcaaaaaatgtggatgccatagacgatgcagctgcacctaagcaatttttagcaaagcaagaagtggccaaagatgtcacttcagaaacttcctgccctactaaggacagttcggacgaccgtcaaacatgggaatcatcagaaattctttatcgtaataagctaggaaaatggacaagaaccagagcatcctgtttgtttgacatagaagcctgtcacaggtacttaaacattgcattgtggtgcagggatcctttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatgtagttactaacgtagaaaaagaaaaagaaccccatttggttgaagaagtttctgttctccctaaagaggagcaatttgttggacagatgggtttaacagaaaacaaacacagttttcaggatactcagttccagaacccaacatggtgtgactactgtaagaaaaaagtttggactaaagcagcttcccagtgtatgttttgtgcttatgtttgccataaaaaatgtcaagaaaagtgtctagctgagacttctgtttgtggagcaactgataggcgaatagacaggacactgaaaaaccttaggctggaaggacaggaaaccctcttaggcctgcctcctcgtgttgatgctgaagctagcaagtcagtcaataaaacaacaggtttgacaaggcatattatcaatactagttctcgtttattaaatttgcgtcaagtctctaaaactcgcctttctgaaccaggaaccgatctcgtagaaccttcaccaaaacacacacccaacacgtcagacaacgaaggcagtgacacggaggtctgtggtccaaacagtccttctaaacggggaaacagcacaggaataaagttagtgagaaaagagggtggtctggatgacagtgttttcattgcagttaaagaaattggtcgtgatctgtacaggggcttgcctacagaggaaaggatccagaaactagagttcatgttggataagctacagaatgaaattgatcaggagttggaacacaataattcccttgttagagaagaaaaagagacaactgatacaaggaaaaaatcacttctttctgctgccttagctaaatcaggtgaaaggctacaagctctaacacttcttatgattcactacagagcaggcattgaagatatagaaactttagaaagtctgtctttagaccagcactccaaaaaaataagcaagtacacagatgatacagaagaagaccttgataatgaaataagccaactaatagactctcagccattcagcagcatatcagatgacttatttggcccatccgagtctgtgtagcagacaggtctatttaaactttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagcttactaattggttgttttggattgcatttatagctatgcttttttgggtttatactgggaatttatttttactaaattatttaacttttctaattatgtaattatgtaagctagcttttcatgtttatgtatgtatggtgtccccttgtgttatttttcttcctcttggtttttgaattagtgttaaatagaatactgtctagattcttaaaatattttcatttccatcatggttataacaaatttgctgcatgcccaaactgacaacagcaatcactgagggaacaggttttgaatctttcttttgtgttatgaagtttatcgtctctacttgcttgagatttttgttattttgggggtttgggggtgctttttgttttgtttttgccaaatgtaacatgaaagcagatgctgcagctttagtctgttatgctgatttagtaaaaaaaaattttttacatatattgcttgctttcgatgcttctgtgaaatttttttctaaagcttttgtgcagctgtatggtaaaaatatggtgattaatttgaagagcttacattgaaagacaatgtaataggaaataaatgtagattgcagttggtcaagaattttgtagagaggataacaagacttaattactgaaaaacagtaacatagcattttgaaatataatcttttaaaatattgatgctttccttttaaatggaaatttaaattttatgattaaaagtttaaacatttatgataattttcctcatcagttctcccataggaaataaagcatgtgaaagggtatttaaagttttggaggactctttttaaaatgactgtgttgataactagtttgggctggttttgttttagaaaaaacattttcatgtaggagtattctgtgaaggaaaggaatcatgcaaaatatactttttgctttggcgtcttacagttgtaaaggaatggtgatcattctgaatacttctgtagtgagtattcattaagaaaagaatgacaaaaatagtattcatacataggaattgggaccagttctctgaaaatgaagatatactcacactgggtccattttacgggtcccagtaacatttgactgagggaaaacaagtaagctcgactgttgttggggtaccttaatggtttcggtctgttatatacctataaaatagacaagtatatgtttgtccctttgtaggtaactgctatgatgattgctatatagtgaaact

SEQ ID NO: 458521 - DNA, 4339 bp, Homo sapiens
gaggcgccggtcccggccccgctgccgccgccgccacaccggcccttcgggagcgtctgaggaggcgcgggccgctgcgggctcgggcgccgcagcgcgccggcccgagcccctggacgaggcccacggagccgctcgccccgacccagccgcccgatgtcctcaaaatggaggcagcgggggcggcggcgtgaagaaagcggcgctgtgggcgcgggagtaggggcccgggcggaggcggtggcgggatggggctgctgctcatgatcctggcgtcggccgtgctgggttccttcctcacgctcctcgcccagttcttcctgctgtaccgcagacagcccgagccgccggcggacgaggccgcccgcgcgggcgagggcttccgctacatcaagccagtgccgggcctgctcctaagggagtacctttatggcggcggccgggatgaggagccctccggagcggcccctgagggcggcgcgacccccaccgcggcccccgagacccccgccccgccgacgcgggagacttgctacttcctcaacgccaccatcctattcctgttccgggagttgcgggacaccgcgctgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtggaagacccgctgatcgacttcgaggtgcgctcgcagtttgaagggcggcccatgccccagctcacctccatcatcgtcaaccagctcaagaagatcatcaagcgcaagcacaccctaccgaattacaagatcaggtttaagccgttttttccataccagaccttgcaaggatttgaagaagatgaagagcatatccatatacaacaatgggcacttactgaaggccgtcttaaagttacgttgttagaatgtagcaggttactcatttttggatcctatgacagagaggcaaatgttcattgcacacttgagttaagcagtagtgtttgggaagaaaaacagaggagttctattaagacggttgaattaatggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtggtgtgaaaatcacatcaacactgcaagtgttgaagcttatcaagcaggctggtgactggtcctggtgtactatgggcctgttggccagagtaatcaaggtgcagtgctgcaagataactttggccagttggaagaaaactttttgtcaagctcatgccaatcgggttatgaagaggaagctgccgggttgacagtagatactgaaagtagagagctggattctgaatttgaagacttggcaagtgatgtcagagcacaaaatgagttcaaagatgaggcacaatcattaagtcatagtcccaaacgtgttccaacaacactttctattaaaccccttggagctatatcaccagttttaaaccgtaaattagctgtaggaagtcacccactaccaccgaaaattcagtccaaagatggaaataaacctccacccctaaaaacttctgagataacagacccagcacaagtgtcaaaaccaacccaaggatctgctttcaaaccacctgtgccaccacgaccacaagcgaaagttcctttgccttccgccgatgctccaaatcaggcagaaccagatgttctcgttgaaaagccagagaaggtggtgccacctcctcttgtagataaatctgctgaaaagcaagcaaaaaatgtggatgccatagacgatgcagctgcacctaagcaatttttagcaaagcaagaagtggccaaagatgtcacttcagaaacttcctgccctactaaggacagttcggacgaccgtcaaacatgggaatcatcagaaattctttatcgtaataagctaggaaaatggacaagaaccagagcatcctgtttgtttgacatagaagcctgtcacaggtacttaaacattgcattgtggtgcagggatcctttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatgtagttactaacgtagaaaaagaaaaagaaccccatttggttgaagaagtttctgttctccctaaagaggagcaatttgttggacagatgggtttaacagaaaacaaacacagttttcaggatactcagttccagaacccaacatggtgtgactactgtaagaaaaaagtttggactaaagcagcttcccagtgtatgttttgtgcttatgtttgccataaaaaatgtcaagaaaagtgtctagctgagacttctgtttgtggagcaactgataggcgaatagacaggacactgaaaaaccttaggctggaaggacaggaaaccctcttaggcctgcctcctcgtgttgatgctgaagctagcaagtcagtcaataaaacaacaggtttgacaaggcatattatcaatactagttctcgtttattaaatttgcgtcaagtctctaaaactcgcctttctgaaccaggaaccgatctcgtagaaccttcaccaaaacacacacccaacacgtcagacaacgaaggcagtgacacggaggtctgtggtccaaacagtccttctaaacggggaaacagcacaggaataaagttagtgagaaaagagggtggtctggatgacagtgttttcattgcagttaaagaaattggtcgtgatctgtacaggggcttgcctacagaggaaaggatccagaaactagagttcatgttggataagctacagaatgaaattgatcaggagttggaacacaataattcccttgttagagaagaaaaagagacaactgatacaaggaaaaaatcacttctttctgctgccttagctaaatcaggtgaaaggctacaagctctaacacttcttatgattcactacagagcaggcattgaagatatagaaactttagaaagtctgtctttagaccagcactccaaaaaaataagcaagtacacagatgatacagaagaagaccttgataatgaaataagccaactaatagactctcagccattcagcagcatatcagatgacttatttggcccatccgagtctgtgtagcagacaggtctatttaaactttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagcttactaattggttgttttggattgcatttatagctatgcttttttgggtttatactgggaatttatttttactaaattatttaacttttctaattatgtaattatgtaagctagcttttcatgtttatgtatgtatggtgtccccttgtgttatttttcttcctcttggtttttgaattagtgttaaatagaatactgtctagattcttaaaatattttcatttccatcatggttataacaaatttgctgcatgcccaaactgacaacagcaatcactgagggaacaggttttgaatctttcttttgtgttatgaagtttatcgtctctacttgcttgagatttttgttattttgggggtttgggggtgctttttgttttgtttttgccaaatgtaacatgaaagcagatgctgcagctttagtctgttatgctgatttagtaaaaaaaaattttttacata

SEQ ID NO: 458522 - DNA, 3086 bp, Homo sapiens
gaacagcattaatggaccccagttggtaaatcggttatggcacacccataaaatgaaattctccaccccatcggcgtgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtggaagacccgctgatcgacttcgaggtgcgctcgcagtttgaagggcggcccatgccccagctcacctccatcatcgtcaaccagctcaagaagatcatcaagcgcaagcacaccctaccgaattacaagatcaggttgaattaatggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtgtggtcctggtgtactatgggcctgttggccagagtaatcaaggtgcagtgctgcaagataactttggccagttggaagaaaactttttgtcaagctcatgccaatcgggttatgaagaggaagctgccgggttgacagtagatactgaaagtagagagctggattctgaatttgaagacttggcaagtgatgtcagagcacaaaatgagttcaaagatgaggcacaatcattaagtcatagtcccaaacgtgttccaacaacactttctattaaaccccttggagctatatcaccagttttaaaccgtaaattagctgtaggaagtcacccactaccaccgaaaattcagtccaaagatggaaataaacctccacccctaaaaacttctgagataacagacccagcacaagtgtcaaaaccaacccaaggatctgctttcaaaccacctgtgccaccacgaccacaagcgaaagttcctttgccttccgccgatgctccaaatcaggcagaaccagatgttctcgttgaaaagccagagaaggtggtgccacctcctcttgtagataaatctgctgaaaagcaagcaaaaaatgtggatgccatagacgatgcagctgcacctaagcaatttttagcaaagcaagaagtggccaaagatgtcacttcagaaacttcctgccctactaaggacagttcggacgaccgtcaaacatgggaatcatcagaaattctttatcgtaataagctaggaaaatggacaagaaccagagcatcctgtttgtttgacatagaagcctgtcacaggtacttaaacattgcattgtggtgcagggatcctttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatgtagttactaacgtagaaaaagaaaaagaaccccatttggttgaagaagtttctgttctccctaaagaggagcaatttgttggacagatgggtttaacagaaaacaaacacagttttcaggatactcagttccagaacccaacatggtgtgactactgtaagaaaaaagtttggactaaagcagcttcccagtgtatgttttgtgcttatgtttgccataaaaaatgtcaagaaaagtgtctagctgagacttctgtttgtggagcaactgataggcgaatagacaggacactgaaaaaccttaggctggaaggacaggaaaccctcttaggcctgcctcctcgtgttgatgctgaagctagcaagtcagtcaataaaacaacaggtttgacaaggcatattatcaatactagttctcgtttattaaatttgcgtcaagtctctaaaactcgcctttctgaaccaggaaccgatctcgtagaaccttcaccaaaacacacacccaacacgtcagacaacgaaggcagtgacacggaggtctgtggtccaaacagtccttctaaacggggaaacagcacaggaataaagttagtgagaaaagagggtggtctggatgacagtgttttcattgcagttaaagaaattggtcgtgatctgtacaggggcttgcctacagaggaaaggatccagaaactagagttcatgttggataagctacagaatgaaattgatcaggagttggaacacaataattcccttgttagagaagaaaaagagacaactgatacaaggaaaaaatcacttctttctgctgccttagctaaatcaggtgaaaggctacaagctctaacacttcttatgattcactacagagcaggcattgaagatatagaaactttagaaagtctgtctttagaccagcactccaaaaaaataagcaagtacacagatgatacagaagaagaccttgataatgaaataagccaactaatagactctcagccattcagcagcatatcagatgacttatttggcccatccgagtctgtgtagcagacaggtctatttaaactttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagctta

SEQ ID NO: 458523 - DNA, 3986 bp, Homo sapiens
gaggcgccggtcccggccccgctgccgccgccgccacaccggcccttcgggagcgtctgaggaggcgcgggccgctgcgggctcgggcgccgcagcgcgccggcccgagcccctggacgaggcccacggagccgctcgccccgacccagccgcccgatgtcctcaaaatggaggcagcgggggcggcggcgtgaagaaagcggcgctgtgggcgcgggagtaggggcccgggcggaggcggtggcgggatggggctgctgctcatgatcctggcgtcggccgtgctgggttccttcctcacgctcctcgcccagttcttcctgctgtaccgcagacagcccgagccgccggcggacgaggccgcccgcgcgggcgagggcttccgctacatcaagccagtgccgggcctgctcctaagggagtacctttatggcggcggccgggatgaggagccctccggagcggcccctgagggcggcgcgacccccaccgcggcccccgagacccccgccccgccgacgcgggagacttgctacttcctcaacgccaccatcctattcctgttccgggagttgcgggacaccgcgctgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtggaagacccgctgatcgacttcgaggtgcgctcgcagtttgaagggcggcccatgccccagctcacctccatcatcgtcaaccagctcaagaagatcatcaagcgcaagcacaccctaccgaattacaagatcaggtttaagccgttttttccataccagaccttgcaaggatttgaagaagatgaagagcatatccatatacaacaatgggcacttactgaaggccgtcttaaagttacgttgttagaatgtagcaggttactcatttttggatcctatgacagagaggcaaatgttcattgcacacttgagttaagcagtagtgtttgggaagaaaaacagaggagttctattaagacggttgaattaatggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtgttcaaactgagagatgtcatctaacctaagaagagatagaaagcaattaggagttagcatcctggcactctttttgggatcctgtgtcatcatctggtttgaaaaggtgtgaaaatcacatcaacactgcaagtgttgaagcttatcaagcaggctggtgactggtcctggtgtactatgggcctgttggccagagtaatcaaggtgcagtgctgcaagataactttggccagttggaagaaaactttttgtcaagctcatgccaatcgggttatgaagaggaagctgccgggttgacagtagatactgaaagtagagagctggattctgaatttgaagacttggcaagtgatgtcagagcacaaaatgagttcaaagatgaggcacaatcattaagtcatagtcccaaacgtgttccaacaacactttctattaaaccccttggagctatatcaccagttttaaaccgtaaattagctgtaggaagtcacccactaccaccgaaaattcagtccaaagatggaaataaacctccacccctaaaaacttctgagataacagacccagcacaagtgtcaaaaccaacccaaggatctgctttcaaaccacctgtgccaccacgaccacaagcgaaagttcctttgccttccgccgatgctccaaatcaggcagaaccagatgttctcgttgaaaagccagagaaggtggtgccacctcctcttgtagataaatctgctgaaaagcaagcaaaaaatgtggatgccatagacgatgcagctgcacctaagcaatttttagcaaagcaagaagtggccaaagatgtcacttcagaaacttcctgccctactaaggacagttcggacgaccgtcaaacatgggaatcatcagaaattctttatcgtaataagctaggaaaatggacaagaaccagagcatcctgtttgtttgacatagaagcctgtcacaggtacttaaacattgcattgtggtgcagggatcctttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatgtagttactaacgtagaaaaagaaaaagaaccccatttggttgaagaagtttctgttctccctaaagaggagcaatttgttggacagatgggtttaacagaaaacaaacacagttttcaggatactcagttccagaacccaacatggtgtgactactgtaagaaaaaagtttggactaaagcagcttcccagtgtatgttttgtgcttatgtttgccataaaaaatgtcaagaaaagtgtctagctgagacttctgtttgtggagcaactgataggcgaatagacaggacactgaaaaaccttaggctggaaggacaggaaaccctcttaggcctgcctcctcgtgttgatgctgaagctagcaagtcagtcaataaaacaacaggtttgacaaggcatattatcaatactagttctcgtttattaaatttgcgtcaagtctctaaaactcgcctttctgaaccaggaaccgatctcgtagaaccttcaccaaaacacacacccaacacgtcagacaacgaaggcagtgacacggaggtctgtggtccaaacagtccttctaaacggggaaacagcacaggaataaagttagtgagaaaagagggtggtctggatgacagtgttttcattgcagttaaagaaattggtcgtgatctgtacaggggcttgcctacagaggaaaggatccagaaactagagttcatgttggataagctacagaatgaaattgatcaggagttggaacacaataattcccttgttagagaagaaaaagagacaactgatacaaggaaaaaatcacttctttctgctgccttagctaaatcaggtgaaaggctacaagctctaacacttcttatgattcactacagagcaggcattgaagatatagaaactttagaaagtctgtctttagaccagcactccaaaaaaataagcaagtacacagatgatacagaagaagaccttgataatgaaataagccaactaatagactctcagccattcagcagcatatcagatgacttatttggcccatccgagtctgtgtagcagacaggtctatttaaactttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagctta

SEQ ID NO: 458524 - DNA, 3479 bp, Homo sapiens
caaagtgaactgaaacatgtatctgagtgctgtgattttggtttcttaaacataatttatggaacatattttaacattttttatggttaaacgttgtcattataaacacaggctgatgacatgtaacccatactattgtgaaatcagtattgaaggagagtggcttctttttagacagacagacacacagacacacacacactctcacacacacacacacacacacacacacccataaattatgttgattgtggtctccagcagttaagcatgttgaattcaaggtctgtccaggcaccatactggcacagtatccttctcccattcccacacacaaacaaaatactaaacacatatgtgtttgcaaccttctctgacactccagaagacttgatttttaatttcacatttttagaaaggtcaatattgataaactgtagattatacttttcttggattgatatagaataacaaacttgcttttactagtctggtatataattgccaattttcatgaaatcacaatgctttagaacacatttctctttattctgtaatcagcacattgagtatttacgcctgtgaattcttcatgtattgtagggagaatggagctgatgatatggtgggtggggtactgaatgtctgggcttgatttgcataactttgatagaaaagctagaaaatttttcacttctcagcattaatagttcttgttggtttaagccgttttttccataccagaccttgcaaggatttgaagaagatgaagagcatatccatatacaacaatgggcacttactgaaggccgtcttaaagttacgttgttagaatgtagcaggttactcatttttggatcctatgacagagaggcaaatgttcattgcacacttgagttaagcagtagtgtttgggaagaaaaacagaggagttctattaagacggttgaattaatggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtggtgtgaaaatcacatcaacactgcaagtgttgaagcttatcaagcaggctggtgactggtcctggtgtactatgggcctgttggccagagtaatcaaggtgcagtgctgcaagataactttggccagttggaagaaaactttttgtcaagctcatgccaatcgggttatgaagaggaagctgccgggttgacagtagatactgaaagtagagagctggattctgaatttgaagacttggcaagtgatgtcagagcacaaaatgagttcaaagatgaggcacaatcattaagtcatagtcccaaacgtgttccaacaacactttctattaaaccccttggagctatatcaccagttttaaaccgtaaattagctgtaggaagtcacccactaccaccgaaaattcagtccaaagatggaaataaacctccacccctaaaaacttctgagataacagacccagcacaagtgtcaaaaccaacccaaggatctgctttcaaaccacctgtgccaccacgaccacaagcgaaagttcctttgccttccgccgatgctccaaatcaggcagaaccagatgttctcgttgaaaagccagagaaggtggtgccacctcctcttgtagataaatctgctgaaaagcaagcaaaaaatgtggatgccatagacgatgcagctgcacctaagcaatttttagcaaagcaagaagtggccaaagatgtcacttcagaaacttcctgccctactaaggacagttcggacgaccgtcaaacatgggaatcatcagaaattctttatcgtaataagctaggaaaatggacaagaaccagagcatcctgtttgtttgacatagaagcctgtcacaggtacttaaacattgcattgtggtgcagggatcctttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatgtagttactaacgtagaaaaagaaaaagaaccccatttggttgaagaagtttctgttctccctaaagaggagcaatttgttggacagatgggtttaacagaaaacaaacacagttttcaggatactcagttccagaacccaacatggtgtgactactgtaagaaaaaagtttggactaaagcagcttcccagtgtatgttttgtgcttatgtttgccataaaaaatgtcaagaaaagtgtctagctgagacttctgtttgtggagcaactgataggcgaatagacaggacactgaaaaaccttaggctggaaggacaggaaaccctcttaggcctgcctcctcgtgttgatgctgaagctagcaagtcagtcaataaaacaacaggtttgacaaggcatattatcaatactagttctcgtttattaaatttgcgtcaagtctctaaaactcgcctttctgaaccaggaaccgatctcgtagaaccttcaccaaaacacacacccaacacgtcagacaacgaaggcagtgacacggaggtctgtggtccaaacagtccttctaaacggggaaacagcacaggaataaagttagtgagaaaagagggtggtctggatgacagtgttttcattgcagttaaagaaattggtcgtgatctgtacaggggcttgcctacagaggaaaggatccagaaactagagttcatgttggataagctacagaatgaaattgatcaggagttggaacacaataattcccttgttagagaagaaaaagagacaactgatacaaggaaaaaatcacttctttctgctgccttagctaaatcaggtgaaaggctacaagctctaacacttcttatgattcactacagagcaggcattgaagatatagaaactttagaaagtctgtctttagaccagcactccaaaaaaataagcaagtacacagatgatacagaagaagaccttgataatgaaataagccaactaatagactctcagccattcagcagcatatcagatgacttatttggcccatccgagtctgtgtagcagacaggtctatttaaactttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagctta

SEQ ID NO: 458525 - DNA, 472 bp, Homo sapiens
gcatgttgaattcaaggtctgtccaggcaccatactggcacagtatccttctcccattcccacacacaaacaaaatactaaacacatatgtgtttgcaaccttctctgacactccagaagacttgatttttaatttcacatttttagaaaggtcaatattgataaactgtagattatacttttcttggattgatatagaataacaaacttgcttttactagtctggtatataattgccaattttcatgaaatcacaatgctttagaacacatttctctttattctgtaatcagcacattgagtatttacgcctgtgaattcttcatgtattgtagggagaatggagctgatgatatggtgggtggggtactgaatgtctgggcttgatttgcataactttgatagaaaagctagaaaatttttcacttctcagcattaatagttcttgttggtatgtacttaaaaacaaaaa

SEQ ID NO: 458526 - DNA, 3880 bp, Homo sapiens
gaggcgccggtcccggccccgctgccgccgccgccacaccggcccttcgggagcgtctgaggaggcgcgggccgctgcgggctcgggcgccgcagcgcgccggcccgagcccctggacgaggcccacggagccgctcgccccgacccagccgcccgatgtcctcaaaatggaggcagcgggggcggcggcgtgaagaaagcggcgctgtgggcgcgggagtaggggcccgggcggaggcggtggcgggatggggctgctgctcatgatcctggcgtcggccgtgctgggttccttcctcacgctcctcgcccagttcttcctgctgtaccgcagacagcccgagccgccggcggacgaggccgcccgcgcgggcgagggcttccgctacatcaagccagtgccgggcctgctcctaagggagtacctttatggcggcggccgggatgaggagccctccggagcggcccctgagggcggcgcgacccccaccgcggcccccgagacccccgccccgccgacgcgggagacttgctacttcctcaacgccaccatcctattcctgttccgggagttgcgggacaccgcgctgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtggaagacccgctgatcgacttcgaggtgcgctcgcagtttgaagggcggcccatgccccagctcacctccatcatcgtcaaccagctcaagaagatcatcaagcgcaagcacaccctaccgaattacaagatcaggtttaagccgttttttccataccagaccttgcaaggatttgaagaagatgaagagcatatccatatacaacaatgggcacttactgaaggccgtcttaaagttacgttgttagaatgtagcaggttactcatttttggatcctatgacagagaggcaaatgttcattgcacacttgagttaagcagtagtgtttgggaagaaaaacagaggagttctattaagacggttgaattaatggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtggtgtgaaaatcacatcaacactgcaagtgttgaagcttatcaagcaggctggtgactggtcctggtgtactatgggcctgttggccagagtaatcaaggtgcagtgctgcaagataactttggccagttggaagaaaactttttgtcaagctcatgccaatcgggttatgaagaggaagctgccgggttgacagtagatactgaaagtagagagctggattctgaatttgaagacttggcaagtgatgtcagagcacaaaatgagttcaaagatgaggcacaatcattaagtcatagtcccaaacgtgttccaacaacactttctattaaaccccttggagctatatcaccagttttaaaccgtaaattagctgtaggaagtcacccactaccaccgaaaattcagtccaaagatggaaataaacctccacccctaaaaacttctgagataacagacccagcacaagtgtcaaaaccaacccaaggatctgctttcaaaccacctgtgccaccacgaccacaagcgaaagttcctttgccttccgccgatgctccaaatcaggcagaaccagatgttctcgttgaaaagccagagaaggtggtgccacctcctcttgtagataaatctgctgaaaagcaagcaaaaaatgtggatgccatagacgatgcagctgcacctaagcaatttttagcaaagcaagaagtggccaaagatgtcacttcagaaacttcctgccctactaaggacagttcggacgaccgtcaaacatgggaatcatcagaaattctttatcgtaataagctaggaaaatggacaagaaccagagcatcctgtttgtttgacatagaagcctgtcacaggtacttaaacattgcattgtggtgcagggatcctttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatgtagttactaacgtagaaaaagaaaaagaaccccatttggttgaagaagtttctgttctccctaaagaggagcaatttgttggacagatgggtttaacagaaaacaaacacagttttcaggatactcagttccagaacccaacatggtgtgactactgtaagaaaaaagtttggactaaagcagcttcccagtgtatgttttgtgcttatgtttgccataaaaaatgtcaagaaaagtgtctagctgagacttctgtttgtggagcaactgataggcgaatagacaggacactgaaaaaccttaggctggaaggacaggaaaccctcttaggcctgcctcctcgtgttgatgctgaagctagcaagtcagtcaataaaacaacaggtttgacaaggcatattatcaatactagttctcgtttattaaatttgcgtcaagtctctaaaactcgcctttctgaaccaggaaccgatctcgtagaaccttcaccaaaacacacacccaacacgtcagacaacgaaggcagtgacacggaggtctgtggtccaaacagtccttctaaacggggaaacagcacaggaataaagttagtgagaaaagagggtggtctggatgacagtgttttcattgcagttaaagaaattggtcgtgatctgtacaggggcttgcctacagaggaaaggatccagaaactagagttcatgttggataagctacagaatgaaattgatcaggagttggaacacaataattcccttgttagagaagaaaaagagacaactgatacaaggaaaaaatcacttctttctgctgccttagctaaatcaggtgaaaggctacaagctctaacacttcttatgattcactacagagcaggcattgaagatatagaaactttagaaagtctgtctttagaccagcactccaaaaaaataagcaagtacacagatgatacagaagaagaccttgataatgaaataagccaactaatagactctcagccattcagcagcatatcagatgacttatttggcccatccgagtctgtgtagcagacaggtctatttaaactttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagctta

SEQ ID NO: 458527 - DNA, 4797 bp, Homo sapiens
gaggcgccggtcccggccccgctgccgccgccgccacaccggcccttcgggagcgtctgaggaggcgcgggccgctgcgggctcgggcgccgcagcgcgccggcccgagcccctggacgaggcccacggagccgctcgccccgacccagccgcccgatgtcctcaaaatggaggcagcgggggcggcggcgtgaagaaagcggcgctgtgggcgcgggagtaggggcccgggcggaggcggtggcgggatggggctgctgctcatgatcctggcgtcggccgtgctgggttccttcctcacgctcctcgcccagttcttcctgctgtaccgcagacagcccgagccgccggcggacgaggccgcccgcgcgggcgagggcttccgctacatcaagccagtgccgggcctgctcctaagggagtacctttatggcggcggccgggatgaggagccctccggagcggcccctgagggcggcgcgacccccaccgcggcccccgagacccccgccccgccgacgcgggagacttgctacttcctcaacgccaccatcctattcctgttccgggagttgcgggacaccgcgctgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtggaagacccgctgatcgacttcgaggtgcgctcgcagtttgaagggcggcccatgccccagctcacctccatcatcgtcaaccagctcaagaagatcatcaagcgcaagcacaccctaccgaattacaagatcaggtttaagccgttttttccataccagaccttgcaaggatttgaagaagatgaagagcatatccatatacaacaatgggcacttactgaaggccgtcttaaagttacgttgttagaatgtagcaggttactcatttttggatcctatgacagagaggcaaatgttcattgcacacttgagttaagcagtagtgtttgggaagaaaaacagaggagttctattaagacggttgaattaatggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtggtgtgaaaatcacatcaacactgcaagtgttgaagcttatcaagcaggctggtgactggtcctggtgtactatgggcctgttggccagagtaatcaaggtgcagtgctgcaagataactttggccagttggaagaaaactttttgtcaagctcatgccaatcgggttatgaagaggaagctgccgggttgacagtagatactgaaagtagagagctggattctgaatttgaagacttggcaagtgatgtcagagcacaaaatgagttcaaagatgaggcacaatcattaagtcatagtcccaaacgtgttccaacaacactttctattaaaccccttggagctatatcaccagttttaaaccgtaaattagctgtaggaagtcacccactaccaccgaaaattcagtccaaagatggaaataaacctccacccctaaaaacttctgagataacagacccagcacaagtgtcaaaaccaacccaaggatctgctttcaaaccacctgtgccaccacgaccacaagcgaaagttcctttgccttccgccgatgctccaaatcaggcagaaccagatgttctcgttgaaaagccagagaaggtggtgccacctcctcttgtagataaatctgctgaaaagcaagcaaaaaatgtggatgccatagacgatgcagctgcacctaagcaatttttagcaaagcaagaagtggccaaagatgtcacttcagaaacttcctgccctactaaggacagttcggacgaccgtcaaacatgggaatcatcagaaattctttatcgtaataagctaggaaaatggacaagaaccagagcatcctgtttgtttgacatagaagcctgtcacaggtacttaaacattgcattgtggtgcagggatcctttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatgtagttactaacgtagaaaaagaaaaagaaccccatttggttgaagaagtttctgttctccctaaagaggagcaatttgttggacagatgggtttaacagaaaacaaacacagttttcaggatactcagttccagaacccaacatggtgtgactactgtaagaaaaaagtttggactaaagcagcttcccagtgtatgttttgtgcttatgtttgccataaaaaatgtcaagaaaagtgtctagctgagacttctgtttgtggagcaactgataggcgaatagacaggacactgaaaaaccttaggctggaaggacaggaaaccctcttaggcctgcctcctcgtgttgatgctgaagctagcaagtcagtcaataaaacaacaggtttgacaaggcatattatcaatactagttctcgtttattaaatttgcgtcaagtctctaaaactcgcctttctgaaccaggaaccgatctcgtagaaccttcaccaaaacacacacccaacacgtcagacaacgaaggcagtgacacggaggtctgtggtccaaacagtccttctaaacggggaaacagcacaggaataaagttagtgagaaaagagggtggtctggatgacagtgttttcattgcagttaaagaaattggtcgtgatctgtacaggggcttgcctacagaggaaaggatccagaaactagagttcatgttggataagctacagaatgaaattgatcaggagttggaacacaataattcccttgttagagaagaaaaagagacaactgatacaaggaaaaaatcacttctttctgctgccttagctaaatcaggtgaaaggctacaagctctaacacttcttatgattcactacagagcaggcattgaagatatagaaactttagaaagtctgtctttagaccagcactccaaaaaaataagcaagtacacagatgatacagaagaagaccttgataatgaaataagccaactaatagactctcagccattcagcagcatatcagatgacttatttggcccatccgagtctgtgtagcagacaggtctatttaaactttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagcttactaattggttgttttggattgcatttatagctatgcttttttgggtttatactgggaatttatttttactaaattatttaacttttctaattatgtaattatgtaagctagcttttcatgtttatgtatgtatggtgtccccttgtgttatttttcttcctcttggtttttgaattagtgttaaatagaatactgtctagattcttaaaatattttcatttccatcatggttataacaaatttgctgcatgcccaaactgacaacagcaatcactgagggaacaggttttgaatctttcttttgtgttatgaagtttatcgtctctacttgcttgagatttttgttattttgggggtttgggggtgctttttgttttgtttttgccaaatgtaacatgaaagcagatgctgcagctttagtctgttatgctgatttagtaaaaaaaaattttttacatatattgcttgctttcgatgcttctgtgaaatttttttctaaagcttttgtgcagctgtatggtaaaaatatggtgattaatttgaagagcttacattgaaagacaatgtaataggaaataaatgtagattgcagttggtcaagaattttgtagagaggataacaagacttaattactgaaaaacagtaacatagcattttgaaatataatcttttaaaatattgatgctttccttttaaatggaaatttaaattttatgattaaaagtttaaacatttatgataattttcctcatcagttctcccataggaaataaagcatgtgaaaggcaaaaaaaaaaaaaaaaaattttggggtcgggctgaatttaaactgtttggcgggccggaaggagtcaggccgaaaacggtgaggtgttccaaaagcggagggacaggtgggcggttagagagaacgggc

SEQ ID NO: 458528 - DNA, 3598 bp, Homo sapiens
gaggcgccggtcccggccccgctgccgccgccgccacaccggcccttcgggagcgtctgaggaggcgcgggccgctgcgggctcgggcgccgcagcgcgccggcccgagcccctggacgaggcccacggagccgctcgccccgacccagccgcccgatgtcctcaaaatggaggcagcgggggcggcggcgtgaagaaagcggcgctgtgggcgcgggagtaggggcccgggcggaggcggtggcgggatggggctgctgctcatgatcctggcgtcggccgtgctgggttccttcctcacgctcctcgcccagttcttcctgctgtaccgcagacagcccgagccgccggcggacgaggccgcccgcgcgggcgagggcttccgctacatcaagccagtgccgggcctgctcctaagggagtacctttatggcggcggccgggatgaggagccctccggagcggcccctgagggcggcgcgacccccaccgcggcccccgagacccccgccccgccgacgcgggagacttgctacttcctcaacgccaccatcctattcctgttccgggagttgcgggacaccgcgctgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtggaagacccgctgatcgacttcgaggtgcgctcgcagtttgaagggcggcccatgccccagctcacctccatcatcgtcaaccagctcaagaagatcatcaagcgcaagcacaccctaccgaattacaagatcaggttgaattaatggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtgtggtcctggtgtactatgggcctgttggccagagtaatcaaggtgcagtgctgcaagataactttggccagttggaagaaaactttttgtcaagctcatgccaatcgggttatgaagaggaagctgccgggttgacagtagatactgaaagtagagagctggattctgaatttgaagacttggcaagtgatgtcagagcacaaaatgagttcaaagatgaggcacaatcattaagtcatagtcccaaacgtgttccaacaacactttctattaaaccccttggagctatatcaccagttttaaaccgtaaattagctgtaggaagtcacccactaccaccgaaaattcagtccaaagatggaaataaacctccacccctaaaaacttctgagataacagacccagcacaagtgtcaaaaccaacccaaggatctgctttcaaaccacctgtgccaccacgaccacaagcgaaagttcctttgccttccgccgatgctccaaatcaggcagaaccagatgttctcgttgaaaagccagagaaggtggtgccacctcctcttgtagataaatctgctgaaaagcaagcaaaaaatgtggatgccatagacgatgcagctgcacctaagcaatttttagcaaagcaagaagtggccaaagatgtcacttcagaaacttcctgccctactaaggacagttcggacgaccgtcaaacatgggaatcatcagaaattctttatcgtaataagctaggaaaatggacaagaaccagagcatcctgtttgtttgacatagaagcctgtcacaggtacttaaacattgcattgtggtgcagggatcctttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatgtagttactaacgtagaaaaagaaaaagaaccccatttggttgaagaagtttctgttctccctaaagaggagcaatttgttggacagatgggtttaacagaaaacaaacacagttttcaggatactcagttccagaacccaacatggtgtgactactgtaagaaaaaagtttggactaaagcagcttcccagtgtatgttttgtgcttatgtttgccataaaaaatgtcaagaaaagtgtctagctgagacttctgtttgtggagcaactgataggcgaatagacaggacactgaaaaaccttaggctggaaggacaggaaaccctcttaggcctgcctcctcgtgttgatgctgaagctagcaagtcagtcaataaaacaacaggtttgacaaggcatattatcaatactagttctcgtttattaaatttgcgtcaagtctctaaaactcgcctttctgaaccaggaaccgatctcgtagaaccttcaccaaaacacacacccaacacgtcagacaacgaaggcagtgacacggaggtctgtggtccaaacagtccttctaaacggggaaacagcacaggaataaagttagtgagaaaagagggtggtctggatgacagtgttttcattgcagttaaagaaattggtcgtgatctgtacaggggcttgcctacagaggaaaggatccagaaactagagttcatgttggataagctacagaatgaaattgatcaggagttggaacacaataattcccttgttagagaagaaaaagagacaactgatacaaggaaaaaatcacttctttctgctgccttagctaaatcaggtgaaaggctacaagctctaacacttcttatgattcactacagagcaggcattgaagatatagaaactttagaaagtctgtctttagaccagcactccaaaaaaataagcaagtacacagatgatacagaagaagaccttgataatgaaataagccaactaatagactctcagccattcagcagcatatcagatgacttatttggcccatccgagtctgtgtagcagacaggtctatttaaactttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagctta

SEQ ID NO: 458529 - DNA, 813 bp, Homo sapiens
  misc_feature (743)..(743): n is a, c, g, or t
  misc_feature (762)..(762): n is a, c, g, or t
  misc_feature (790)..(790): n is a, c, g, or t
gtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctgctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtgatgtgatggaagacctctataactacataaatccacataatggcaaacactctcccatggtggccaagtcaacattggatattgttctggccaataaagatcgcctgaattctgctattatctatgaccgagatttctcttacaattacttcggctttaagacgctagagcggtcttatttgttgaagatcaatggaaaagtggcttgaaaggaccacaacatatggttgatgaanaagtatctggttggggatnccccaaaggaaagacctttggatgcccnccaaattgggaaacctttttaaa

SEQ ID NO: 458530 - DNA, 806 bp, Homo sapiens
gtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctgctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtgaaaaaaaaaaaaaactttttgggcggcttgggccctggaaaaagtttttaaaacctttggtggggccgcggggccccatgagggtactgtgacactgggctaaaacagggctccacagggaagaaccggggtcgaagacacaaagggccggggtatcttcgccccgtattataaaaacgcgcccgggaggaaacaccgagggtttctgaaacaatttcccagaaggggattccggagagcccacacacgaggattctatacacaggggggtcccaggagagactcggatataaattaac

SEQ ID NO: 458531 - DNA, 342 bp, Homo sapiens
  misc_feature (340)..(340): n is a, c, g, or t
aaagatcggccgatcttcctttattgagctctcgggcgaggttcactggtccgcagggggagggccagggaagtctcgctgtgccaaaggtgcagcgcgcttttatggatgctgggtgaggagtggtcagggtaggggcagggtcggttgagtttcacgcttctgagtgtgacacgccctagtgggcatgtgcgttagtcggggtggcaggaacaggaaaggtgaacccggaaatgctgagtcagggtgtccgaggtggcgatcgccatcttggagtcttcaccggagtccaatcactgtagcggtggctactgacacaacgagtctcgtagcatgtgtntc

SEQ ID NO: 458532 - DNA, 3026 bp, Homo sapiens
gtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctgctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtgatgtgatggaagacctctataactacataaatccacataatggcaaacactctcccatggtggccaagtcaacattggatattgttctggccaataaagatcgcctgaattctgctattatctatgaccgagatttctcttacaattacttcggctttaagacgctagagcggtcttatttgttgaagatcaatggaaaagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctagatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacgagaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccatttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgaaaaaa

SEQ ID NO: 458533 - DNA, 2575 bp, Homo sapiens
aaagatcggccgatcttcctttattgagctctcgggcgaggttcactggtccgcagggggagggccagggaagtctcgctgtgccaaaggtgcagcgcgcttttatggatgctgggtgaggagtggtcagggtaggggcagggtcggttgagtttcacgcttctgagtgtgacacgccctagtgggcatgtgcgttagtcggggtggcaggaacaggaaaggtgaacccggaaatgctgagtcagggtgtccgaggtggcgatcgccatcttggagtcttcaccggagtccaatcactgtgaaccaaaaacgaagtcaaataacaagtttcacactttgggaggccaagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctagatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacgagaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccatttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgaaaaaa

SEQ ID NO: 458534 - DNA, 1870 bp, Homo sapiens
tcttatgagtgattttgtcctttcctttttaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacgagaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccatttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgaaaaaa

SEQ ID NO: 458535 - DNA, 1045 bp, Homo sapiens
  misc_feature (20)..(20): n is a, c, g, or t
  misc_feature (26)..(26): n is a, c, g, or t
  misc_feature (33)..(33): n is a, c, g, or t
atagctgttccagaggatcnccggangcacacngcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacgagaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccatttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgaaaaaa

SEQ ID NO: 458536 - DNA, 907 bp, Homo sapiens
atgctgcagacactctttaattatcaccgtacagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacgagaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccatttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgaaaaaa

SEQ ID NO: 458537 - DNA, 1829 bp, Homo sapiens
gtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctgctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtgatgtgatggaagacctctataactacataaatccacataatggcaaacactctcccatggtggccaagtcaacattggatattgttctggccaataaagatcgcctgaattctgctattatctatgaccgagatttctcttacaattacttcggctttaagacgctagagcggtcttatttgttgaagatcaatggaaaagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctagatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggtaggtagaaaaaattcttcctagagtactaagaagagaaccttaggcagttattatttgtgaattcctcacttgatttcacttgagataagtgaagggagtttgcatagttgtaagcagaagaacactgttaaaggcagagagcaaaggaaggaaagggtatgatctgtgcctataaatgttttttagtctaagccgtgtgggaaagacacagttttttcttatacacacatcactgtaataacatttactcaagaaaaatagaaatatacagttatgttagtttag

SEQ ID NO: 458538 - DNA, 328 bp, Homo sapiens
gtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgaggtaaggggggacaaggtgggcgagaaggaaggttaagggatgcgggctgccgccgccggagctgatgcccagcccgcccgccgccttc

SEQ ID NO: 458539 - DNA, 524 bp, Homo sapiens
actaaagtcctgggattacaggtgtgagccaccgcgcccggcccaggaatctattttaaactacaagaacttataatcactttaactctagaagaatgtttccttaaatgaggcattacatatttcttcaacatatatgtgtttattgagcactttatatgctaggcattgaggtgggttgagatgacaaaaaggggtgagaaccactgttttcaactattacctaaagattgaattagctgttaagtggtcttgatatattttcattttttgttgtattttttagatgtgatggaagacctctataactacataaatccacataatggcaaacactctcccatggtggccaagtcaacattggatattgttctggccaataaagatgtatgtataacacttatctggtggaaattttttgagagtcttttttaataatgcacacattttagaaaatttaaacacttgcaaagatacagggtaaatactaattctgtttcctaccctgattcctgattttcctc

SEQ ID NO: 458540 - DNA, 390 bp, Homo sapiens
tagctgggattacaggcatgctgcgccaccatgcctggctaattatattgtttcttgaataacagatgtcaagatcttaaaggaatatagctttcgtgtggtggcattgatgtctcgtctttataaaagatagaatttaccaagcaatctagcattaaataactcttaagtgattttagtttaagcttcaaagctgtagtcttttctaagcagtcactgttatttatttcttcatacattttctgcttttccattcagattgtaaatcctcacttattgaaagatcttaccgagcggggcctatggcatgaagagatgaaaaaccagattattgcatgcaatggctctattcaggtatagaatgaaaatgaagtgtgctctgcaggggct

SEQ ID NO: 458541 - DNA, 3097 bp, Homo sapiens
gtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctgctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtgatgtgatggaagacctctataactacataaatccacataatggcaaacactctcccatggtggccaagtcaacattggatattgttctggccaataaagatcgcctgaattctgctattatctatgaccgagatttctcttacaattacttcggctttaagacgctagagcggtcttatttgttgaagatcaatggaaaagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctagatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacgagaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccatttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgaaaaaa

SEQ ID NO: 458542 - DNA, 829 bp, Homo sapiens
  misc_feature (609)..(609): n is a, c, g, or t
  misc_feature (642)..(642): n is a, c, g, or t
  misc_feature (657)..(657): n is a, c, g, or t
  misc_feature (686)..(686): n is a, c, g, or t
  misc_feature (749)..(749): n is a, c, g, or t
  misc_feature (777)..(777): n is a, c, g, or t
  misc_feature (787)..(787): n is a, c, g, or t
  misc_feature (810)..(810): n is a, c, g, or t
  misc_feature (817)..(817): n is a, c, g, or t
gtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctgctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtgatgtgatggaagacctctataactacataaatccacataatggcaaacactctcccatggtggccaagtcaacattggatattgttctggccaataaagatngccctgaattctggctattaacctatgaccggngaatttccccttaanaattaacttcgggcttttaaaaacgctangaacgggtccttaatttggtttgaaaggttcaaatgggggaaaaagtggggttggaaaagganccacaaacaattatggtttggaatgaanaaagtatccnggtttggggaattccaacaaaanggaaagnacaattttgggt

SEQ ID NO: 458543 - DNA, 3075 bp, Homo sapiens
cggcgaggtagaggcaggggtggtaaatcaggcacggaggctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctgctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtgatgtgatggaagacctctataactacataaatccacataatggcaaacactctcccatggtggccaagtcaacattggatattgttctggccaataaagatcgcctgaattctgctattatctatgaccgagatttctcttacaattacttcggctttaagacgctagagcggtcttatttgttgaagatcaatggaaaagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctagatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacgagaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccatttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgaaaaaa

SEQ ID NO: 458544 - DNA, 2919 bp, Homo sapiens
gtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgagatggccgccaagaacgagtcatgtttgacaaaattacatctcgaatccagaagctttgttatggactcaatatggattttgttgatcctatgtgatggaagacctctataactacataaatccacataatggcaaacactctcccatggtggccaagtcaacattggatattgttctggccaataaagatcgcctgaattctgctattatctatgaccgagatttctcttacaattacttcggctttaagacgctagagcggtcttatttgttgaagatcaatggaaaagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctagctgttttcttctgagtatgaaagatgacagcattgaaggcatttatgacactctaaagcaatgtgcattgatttctaagtctgctggaggaattggtgttgctgtgagttgtattcgggctactggcagctacattgctgggactaatggcaattccaatggccttgtaccgatgctgagagtatataacaacacagctagatatgtggatcaaggtgggaacaagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggactggtctttgatgtgtccaaatgagtgtcctggtctggatgaggtttggggagaggaatttgagaaactatatgcaagttatgagaaacaaggtcgtgtccgcaaagttgtaaaagctcagcagctttggtatgccatcattgagtctcagacggaaacaggcaccccgtatatgctctacaaagattcctgtaatcgaaagagcaaccagcagaacctgggaaccatcaaatgcagcaacctgtgcacagaaatagtggagtacaccagcaaagatgaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggaattcttcagtatgatatgtggaatgttactcctacagacctatgggactggaaggttctcaaggagaagattgcaaagtatggtataagaaacagtttacttattgccccgatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacgagaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccatttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgaaaaaa

SEQ ID NO: 458545 - DNA, 1096 bp, Homo sapiens
cctctataggatcccctgccgagatgcctacagcttccactgctcagatcctggggaataatgagtccattgaaccttacaccagcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacgagaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccatttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgaaaaaa

SEQ ID NO: 458546 - DNA, 1048 bp, Homo sapiens
agaagacatgtgtgtagagcgagaacaaagcacactgcaacatctatactcgcagagtcttgtcaggagaatttcagattgtaaatcctcacttattgaaagatcttaccgagcggggcctatggcatgaagagatgaaaaaccagattattgcatgcaatggctctattcagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcagggtttgaagactgggatgtattatttaaggacgagaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccatttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgaaaaaa

SEQ ID NO: 458547 - DNA, 850 bp, Homo sapiens
gacattgtagtcttaataattgctaacatgaatttaataattgctgacatgatttgattctttagatggccgccaagaacgagtcatgtttgacaaaattacatctcgaatccagaagctttgttatggactcaatatggattttgttgatcctgctcagatcaccatgaaagtaatccaaggcttgtacagtggggtcaccacagtggaactagatactttggctgctgaaacagctgcaaccttgactactaagcaccctgactatgctatcctggcagccaggatcgctgtctctaacttgcacaaagaaacaaagaaagtgttcagtgtgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccatttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgaaaaaa

SEQ ID NO: 458548 - DNA, 468 bp, Homo sapiens
tctttcttatgtatgacgtgtaccatgtgctgggttttagtctaggcactggaaatagagtggtaaaaaatatatatattccggccaggcatggtggctcatacctgtaatcccagaactgagagagaccaagacgagtggatagcttgaggtcaggaaggcgaaaccctgtatctactaaaaatacaaaaattagctgggcatggtggcgcatgcttgtaatcccagctactcaggagcctgaggcatgagaattgcttgaacctgcgacacagaggttgcagtgagccgagatcacaccactgcactccaggctgagtgacagagcaagactgtgtctcaaaaaaaaaaaaaaaaaatcccgggggaaaccgttttccccctaaaaaaaattggcacgggggaacccttaaaattcaccctgggggtttgcagcttggccagggcccgccttttaacaaggtcgga

SEQ ID NO: 458549 - DNA, 718 bp, Homo sapiens
gtgaagtttgccagtttctaggaatctccagaggttgttccccagaaccaagccttaactttggtggtatcttcctgttaaatgtggagccagaaccacggcttaaatgttagacactaggatgatgcccactttgtgccacatgatggtggctactgcctgtaggcattttccagtgactgaaagaggctgctagtggtagggatgaggtatcatccaatttcctaaaaagattgaacccttcatattcaccagaagaataacagctgttccccacctcccacacatctgcatcaagctgaagttctgtgtcctcatgagctgatttcacctttgcacagatcttgggggagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagtta

SEQ ID NO: 458550 - DNA, 1209 bp, Homo sapiens
ttttctgaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccagtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcgtggagacgtctacacctgccacgtggagcaccccagcctccagaaccccatcaccgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagtta

SEQ ID NO: 458551 - DNA, 1299 bp, Homo sapiens
aggaaattaagaaaaagcaggaaaatgagagaacatattaccaagtaaataaagcatacattaaatatttactataattttacactaaagaaataaaggaaatgcagtaaaatggccagagaggtaaaggttaagatgtataaaatatgcagggaaaggtgtgtcatttttgaccatgagcagcgctctgagaagataaaggaattgagttatgggcaaacatgatgtttgatcagtgttagtttttttcaaggcctgcctacttttccttcaaatattacaaacttttgaaataacattcaattttttggtctctgttactagattgcaagttctataaaggcaggaaccagggtttgttgtttatttttggattctcagtgattgtcaaatttatatttgttgaaggaaccttaatccaagacttggactccaggtatctttccattctggttccaaggagggaccttcctcacagcaggcgtgctgtgtggtctcacatctcactcctatatctttccctgtctgttactgccctcagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagtta

SEQ ID NO: 458552 - DNA, 828 bp, Homo sapiens
ttttctgaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccagtggctgagggcagagactctcccgtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcgtggagacgtctacacctgccacgtggagcaccccagcctccagaaccccatcaccgtggagtggcggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagtta

SEQ ID NO: 458553 - DNA, 546 bp, Homo sapiens
gtgaagtttgccagtttctaggaatctccagaggttgttccccagaaccaagccttaactttggtggtatcttcctgttaaatgtggagccagaaccacggcttaaatgttagacactaggatgatgcccactttgtgccacatgatggtggctactgcctgtaggcattttccagtgactgaaagaggctgctagtggtagggatgaggtatcatccaatttcctaaaaagattgaacccttcatattcaccagaagaataacagctgttccccacctcccacacatctgcatcaagctgaagttctgtgtcctcatgagctgatttcacctttgcacagatcttgggggaggtgatgacaatacaccctggaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagtta

SEQ ID NO: 458554 - DNA, 310 bp, Homo sapiens
aaggcagggaccatggtatgttgtttgtctttggattctcagtgattgttatatttatatttgttgaaggaaccttaatccaagacttggactccaagtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagtta

SEQ ID NO: 458555 - DNA, 1953 bp, Homo sapiens
ttttctgaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccagtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcgtggagacgtctacacctgccacgtggagcaccccagcctccagaaccccatcaccgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaatgatagaaacccaaatatattttgttcatggtgcaaaggaagcctagagtcaagttgatttcagaagtgactagttccagatacacaatgagatcttcacctctctttctgttatatctctatctgtgaatctgcctctctttctgtgtctctttgtccctgtatagttctttctgcgtgtctctctgcatctttgtctctgcccccttgttgtgtctttcactacattgttgcctttctatttttctaatccatggtcactgtttatctgcattttttctatctccgtgtttctttttgcatctatttttctgcatttctcttc

SEQ ID NO: 458556 - DNA, 1659 bp, Homo sapiens
ttttctgaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccagtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcgtggagacgtctacacctgccacgtggagcaccccagcctccagaaccccatcaccgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagttaaaaaaaaaaaaaaaaaaaaaaaaaaaaaaaaaaaaaaacaaagaaaaaaaaaaaaaaaaaaaaaaaagggggggggggccaaaaaataccccgggggggggcccaatgcccccctttttttgaaaaaaggggcggcccccaatggagggggggccgcttataaaaagaagcggacgacgcaggcgcgccggttaaaacacacagctcgtggggaggggcaaaaccaccggccacgcggggagcaaatctgtggggagacgaggacccccatctctcggggggcgggagacaaaagtggggcaccaaaccccccaccaaggaaattagaggcccccagcagggagatatacaaacaacgcacgggtgtcgtccggggggcacaccccacagcataatgcacggccgaagaaagaatcgcccaccgaagatacgtgacgaacaactttcccg

SEQ ID NO: 458557 - DNA, 1195 bp, Homo sapiens
ttttctgaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccagtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcgtggagacgtctacacctgccacgtggagcaccccagcctccagaaccccatcaccgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagttctatgagttttgatgaatgtgtcctgcttcctcccaggcttccaccatctcttcccctaaaggcaaccaccattctgatttctctcaccataggactggtaatatcccaa

SEQ ID NO: 458558 - DNA, 1090 bp, Homo sapiens
acagataacttttgatcatgtttaattatgtaaaaaggggctaaatttaggtaatggttttcaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcgtggagacgtctacacctgccacgtggagcaccccagcctccagaaccccatcaccgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagtta

SEQ ID NO: 458559 - DNA, 2043 bp, Homo sapiens
aggaaattaagaaaaagcaggaaaatgagagaacatattaccaagtaaataaagcatacattaaatatttactataattttacactaaagaaataaaggaaatgcagtaaaatggccagagaggtaaaggttaagatgtataaaatatgcagggaaaggtgtgtcatttttgaccatgagcagcgctctgagaagataaaggaattgagttatgggcaaacatgatgtttgatcagtgttagtttttttcaaggcctgcctacttttccttcaaatattacaaacttttgaaataacattcaattttttggtctctgttactagattgcaagttctataaaggcaggaaccagggtttgttgtttatttttggattctcagtgattgtcaaatttatatttgttgaaggaaccttaatccaagacttggactccaggtatctttccattctggttccaaggagggaccttcctcacagcaggcgtgctgtgtggtctcacatctcactcctatatctttccctgtctgttactgccctcagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaatgatagaaacccaaatatattttgttcatggtgcaaaggaagcctagagtcaagttgatttcagaagtgactagttccagatacacaatgagatcttcacctctctttctgttatatctctatctgtgaatctgcctctctttctgtgtctctttgtccctgtatagttctttctgcgtgtctctctgcatctttgtctctgcccccttgttgtgtctttcactacattgttgcctttctatttttctaatccatggtcactgtttatctgcattttttctatctccgtgtttctttttgcatctatttttctgcatttctcttc

SEQ ID NO: 458560 - DNA, 1098 bp, Homo sapiens
ttttctgaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccagtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcgtggagacgtctacacctgccacgtggagcaccccagcctccagaaccccatcaccgtggagtggcggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagtta

SEQ ID NO: 458561 - DNA, 1182 bp, Homo sapiens
taggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctccgcgggatcttgcagaggagagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcgtggagacgtctacacctgccacgtggagcaccccagcctccagaaccccatcaccgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagtta

SEQ ID NO: 458562 - DNA, 821 bp, Homo sapiens
  misc_feature (42)..(42): n is a, c, g, or t
  misc_feature (52)..(52): n is a, c, g, or t
taccccaagcaggtaatacagactctactacgaggtggcgtncgcgggatcngcagaggagagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcgtggagacgtctacacctgccacgtggagcaccccagcctccagaaccccatcaccgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagtta

SEQ ID NO: 458563 - DNA, 1330 bp, Homo sapiens
aggaaattaagaaaaagcaggaaaatgagagaacatattaccaagtaaataaagcatacattaaatatttactataattttacactaaagaaataaaggaaatgcagtaaaatggccagagaggtaaaggttaagatgtataaaatatgcagggaaaggtgtgtcatttttgaccatgagcagcgctctgagaagataaaggaattgagttatgggcaaacatgatgtttgatcagtgttagtttttttcaaggcctgcctacttttccttcaaatattacaaacttttgaaataacattcaattttttggtctctgttactagattgcaagttctataaaggcaggaaccagggtttgttgtttatttttggattctcagtgattgtcaaatttatatttgttgaaggaaccttaatccaagacttggactccaggtatctttccattctggttccaaggagggaccttcctcacagcaggcgtgctgtgtggtctcacatctcactcctatatctttccctgtctgttactgccctcagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttcctcgggctgggccttatcatccgtcacaggggtcagaaaggacctcgagggcctccacctgcaggactcctgcactgactcctgaggacttttgtctgggattggtcatcactcttctgtaatgcccacctgcccctgcccagaattcctagctgcctgtgtcatcctgtcccactgaggtcagagtcctacagtggctcatgcagccacaggtcaccttctgtgatccccatcccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctaactttagtgctttttcccataattaaacctgattctgagttatct

SEQ ID NO: 458564 - DNA, 1213 bp, Homo sapiens
taggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttcctcgggctgggccttatcatccgtcacaggggtcagaaaggacctcgagggcctccacctgcaggactcctgcactgactcctgaggacttttgtctgggattggtcatcactcttctgtaatgcccacctgcccctgcccagaattcctagctgcctgtgtcatcctgtcccactgaggtcagagtcctacagtggctcatgcagccacaggtcaccttctgtgatccccatcccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctaactttagtgctttttcccataattaaacctgattctgagttatct

SEQ ID NO: 458565 - DNA, 1306 bp, Homo sapiens
aggaaattaagaaaaagcaggaaaatgagagaacatattaccaagtaaataaagcatacattaaatatttactataattttacactaaagaaataaaggaaatgcagtaaaatggccagagaggtaaaggttaagatgtataaaatatgcagggaaaggtgtgtcatttttgaccatgagcagcgctctgagaagataaaggaattgagttatgggcaaacatgatgtttgatcagtgttagtttttttcaaggcctgcctacttttccttcaaatattacaaacttttgaaataacattcaattttttggtctctgttactagattgcaagttctataaaggcaggaaccagggtttgttgtttatttttggattctcagtgattgtcaaatttatatttgttgaaggaaccttaatccaagacttggactccaggtatctttccattctggttccaaggagggaccttcctcacagcaggcgtgctgtgtggtctcacatctcactcctatatctttccctgtctgttactgccctcagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcgttggaggcttcgtgctggggctgatcttcctcgggctgggccttatcatccgtcacaggggtcagaaaggactcctgcactgactcctgaggacttttgtctgggattggtcatcactcttctgtaatgcccacctgcccctgcccagaattcctagctgcctgtgtcatcctgtcccactgaggtcagagtcctacagtggctcatgcagccacaggtcaccttctgtgatccccatcccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctaactttagtgctttttcccataattaaacctgattctgagttatct

SEQ ID NO: 458566 - DNA, 1842 bp, Homo sapiens
ttttctgaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccagtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcgtggagacgtctacacctgccacgtggagcaccccagcctccagaaccccatcaccgtggagtggcggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagttatctgtattctcaacttccttaattgagcagaggcaggaaatcactgcagaatgaaggaacataccttgaggtgacccagccaacctgtgcccagaaggagggttgtaccttgaaaagacactgaaagaatttggggtgcaaagtcatggtgggcagaggaggtagaaaatcaactcagttgtcgcatcattcatggttctttcatattgatgttcagtgcagtggcctgagaatatcccagcctctcttctggtttggtgagtgctatataagtaaacatggtggaattgtttgggggcagatatagtgacccttggtcactggtgtttcaaacattctggcaagtcacatcaatcaagaataatttttacttttaagaaagcataaccagcaataaaagtattatttttgattctaaatgatagaaacccaaatatattttgttcatggtgcaaaggaagcctagagtcaagttgatttcagaagtgactagttccagatacacaatgagatcttcacctctctttctgttatatctctatctgtgaatctgcctctctttctgtgtctctttgtccctgtatagttctttctgcgtgtctctctgcatctttgtctctgcccccttgttgtgtctttcactacattgttgcctttctatttttctaatccatggtcactgtttatctgcattttttctatctccgtgtttctttttgcatctatttttctgcatttctcttc

SEQ ID NO: 458567 - DNA, 1098 bp, Homo sapiens
taggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggaccttccagatcctggtgatgctggaaatgactccccagcgtggagatgtctacacctgccacgtggagcaccccagcctccagagccccatcaccgtggagtggcgcctcatctctcttctccaggactcctgcactgactcctgaggacttttgtctgggattggtcatcactcttctgtaatgcccacctgcccctgcccagaattcctagctgcctgtgtcatcctgtcccactgaggtcagagtcctacagtggctcatgcagccacaggtcaccttctgtgatccccatcccaaggcactggcggtgactctgcttcctgcactgacccagagcctctgcctgtgcactgcaagctgtgtctactcaggccccaaggggcatctctgtttccattctccccccacagacctgtcaagagaagcatgacaaacaaaatcatttacctaactttagtgctttttcccataattaaacctgattctgagttatct

SEQ ID NO: 458568 - DNA, 1182 bp, Homo sapiens
taggtttgagctgtgttgactaccactgctttttccttggtctcacttatgtcttggaagatggctctgcagatccctggaggcttttgggcagcagctgtgaccgtgatgctggtgatgctgagcaccccagtggctgaggccagagactttcccaaggatttcttggtccagtttaagggcatgtgctacttcaccaacgggacagagcgcgtgcgcggtgtggccagatacatctataaccgcgaggagtacgggcgcttcgacagcgacgttggggagttccaggcggtgaccgagctggggcggagcatcgaggactggaacaactataaggacttcttggagcaggagcgggccgcggtggacaaggtgtgcagacacaactacgaggcggagctccgcgggatcttgcagaggagagtggagcccacagtgaccatctccccatccaggacagaggccctcaaccaccacaacctgctggtctgctcggtgacagatttctatccaggccagatcaaagtccggtggtttcggaatgatcaggaggagacagccggcgttgtgtccaccccccttattaggaatggtgactggaccttccagatcctggtgatgctggaaatgactccccagcgtggagatgtctacacctgccacgtggagcaccccagcctccagagccccatcaccgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagtta

SEQ ID NO: 458569 - DNA, 1187 bp, Homo sapiens
ttttctgaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccagtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctctggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcgtggagacgtctacacctgccacgtggagcaccccagcctccagaaccccatcaccgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagtta

SEQ ID NO: 458570 - DNA, 1158 bp, Homo sapiens
ttttctgaggtacatcagatccatcaggtccaagctgtgttgactaccactacttttcccttcgtctcaattatgtcttggaagaaggctttgcggatccctggaggccttcgggtagcaactgtgaccttgatgctggcgatgctgagcaccccagtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaaccggcgttgtgtccaccccccttattaggaacggtgactggaccttccagatcctggtgatgctggaaatgactccccagcgtggagacgtctacacctgccacgtggagcaccccagcagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtccccctgagatcagagtcctacagtggctgtcacgcagccaccaggtcatctcctttcatccccacctcaaggctgatggctgtgaccctgcttcctgcactgacccagagcctctgcctgtgcacggccagctgcgtctactcaggccccaaggggtttctgtttctattctctcctcagactgctcaagagaagcacatgaaaaccattacctgactttagagcttttttacataattaaacatgatcctgagtta

SEQ ID NO: 458571 - DNA, 795 bp, Homo sapiens
gcggcggctaatactactaaattcggggccggttcgacggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctgtaagttttttatcttaatgactttgtgttttacaagtaagttatgtgtatattctctctaggttaaaaccatttgccaagggtggtataggatttgggaaattttaaacatggaatatgagaatgtacaatttcattataaaacttcttctcatccttataaaacaacttggtagaagatattaagttacattttctataagaacttaaaatatatcatatttgaggcagggcaccattttcttattcataccagctctttagagatcattcaaatgagaggctacatttttaatagtacttgggataaaaccgctctcattttttacattctgtttaatgcagatataaagtt

SEQ ID NO: 458572 - DNA, 1222 bp, Homo sapiens
gaaagtctattctctgggtatctctcctttacgagaatatagcacccacacgtgaccacatctagccttttatgactagtgtcatctatataactagtaccactgtccctgtggcagtgtcatgaagcgaaagacgaaggtaatacaagatggtaaaagcagggaattatttctcgcttatttcttcttttatggagtttgggagtattgaatcatggtcttaatattgaaatatttcaccaaagtccaggggactcctttgggtaatgaggttgagctggcaccagatcagcttccagatttgatgcttagcattttgctggtaagatggctaaaggattttaatttagcctctattctatagtggcttaaaagaacaaagggtggtgcgttttccccttatacactcaaaacctacagctgtttcttgtgaaggctaagccagggccacacatatccaatgagactgactagaaatttctcctgcctttgggaaaggatgactgtcagtgtcagaaaagccaggctctgctgcctaatctgcagtgacctgttagaggtctaataagtcttacccctgtgggctctacctgtagaaacaatactaggtactagtttagggggctgctagaaaataatgaggtcctttgaggagagatcttctaaaatcacacattagtgatactgaattattgagagtgacaaacttttttatcttcacccataataaactttttttatcttcactttgttagcaaatccaaagaaatgtggaatttttagtttagcagattcaaaaagtagaaaacagtttaccttccatatgacatatttatatgcactatttaagctttgaggtgtagcccatttaaatttcttctttgagatttccaaatacattatatccatctcacaatccccccacgtactccaaattttgcatggtttaccattgcccattctgacctcattcttctttctagtacatgcctgcaacgtcagctatgcaaggagcctacttgccacagtatgcacatatgcagacgacagcggttcctgttgaggttggtagagaccatccagtgaccattctggctataagtagtttcagaaatgggtaaattaaatagaactcagaaaaatctaccagacgtcaaatatttgcataaagaattgcgtttagccagatgtggtgggtcatgcctgtaagtccaacactttg

SEQ ID NO: 458573 - DNA, 643 bp, Homo sapiens
ctgaggatccgtatcagagcatacccctaaagaggttaagaaccaatagtaaagagtttacaaaacattattattcccattttataattagaaaattgaggaatagaaattgacagcagctgatttgctgcttaagaaagaaaattagatgtcatagttccctaatcctgtaatgctataagctattagattattaagaccactgaagcatataaaaaatgggggcatctggcccaaattagggtctgtagggagttgtttgccttcccatcatatatccagtgagggccctgcactcatgttggagtgggcctttctccactaaaccaccataagcttatgcaattggatttgagaaattggcagctgcaagaaaccaccaaccccaatggggaaaggctacagtccagataactgaaatgttaacaaggcagaagcacttaactttggtctgccttaggtggcaaaggaaaccagagaaaacaagtatcggggctctgctatcaaggtaaatcgcaatacattcttcccccatgactcttccccatatcctctctgttgaacctctgaagttaacaataggggataaaatgcaggagggttttgttgttaagaattggaaactgaaacttaataaaattac

SEQ ID NO: 458574 - DNA, 576 bp, Homo sapiens
agtgaccagtttgccaagaattctaactgccttaatctttttaatcattgatagtattgtttccttgttttctttctgtagatttttaacatgattaaaaagagttctaaagaaataggtaagctttacaatgaaaatcaatatttctttcaaaatcctcccttttctaggtgcaaagtccttcgtggatgcaacctcaaccatatattctacagcaccctgtaagttttttatcttaatgactttgtgttttacaagtaagttatgtgtatattctctctaggttaaaaccatttgccaagggtggtataggatttgggaaattttaaacatggaatatgagaatgtacaatttcattataaaacttcttctcatccttataaaacaacttggtagaagatattaagttacattttctataagaacttaaaatatatcatatttgaggcagggcaccattttcttattcataccagctctttagagatcattcaaatgagaggctacatttttaatagtacttgggataaaaccgctctcattttttacattctgtttaatgcagatataaagtt

SEQ ID NO: 458575 - DNA, 4360 bp, Homo sapiens
  misc_feature (4024)..(4024): n is a, c, g, or t
  misc_feature (4029)..(4029): n is a, c, g, or t
ggcacgaggggtggagcagcggcagcagcagcagccgccgccgccgccgccgctgccgccgccgccggaaagggagaggcaggagagcccgagacttggaaaccccaaagtgtccgcgaccctgcacggcagctcccttccagcttcatgggcaaagtgtggaaacagcagatgtaccctcagtacgccacctactattacccccagtatctgcaagccaagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaattttaaaaaaacaaaaaaaaaacaaaaaaaaaaaaaaaanttgtnggggcggccagggcccctgagggaagagttttttaaaaacaattggtaggggcaccgcggacccctggaataggttagggtgacgacgtgtgggccacataccgtggttccacaagggaaaactcggggacaggaaacatagtgctgtgggtattctcttccaccgaaataataaacaatcgccggggcgacaaacgcgacgtgttctggaaccaaaatcggaaatgggaagcacgcgacaggcccattccaggggcactcttactcacagcggggaagctcataacgagagagccacaatatacaaataaaggccggcagcgtgagagag

SEQ ID NO: 458576 - DNA, 4625 bp, Homo sapiens
gttaaaaaccaaggacctgatatcttataattcagtttaagcctaatacagttcatgtaaactccttttttggcaatttaacatatacatggatcaagtttagtaggtttagaggaaaatgaatgtcttgttctgaaaaaatagcagtaccagctgagctttggggaggtgacagattgagtcacttcacagcttaattctgttatgaactggtcccatgggcatggattgtcaattagggagacttgaatcttttagatattaaatctacaggcagacaacaaagaacacattattcttttgtaaaaatagaggaacctggctgtctactacagaactagaggaacctagcttagacagaagctcatcccacttcagcacctacaacagatttgatacctttgagcaagattggatacttttctcaaagtaaatactgggttggtaccccagagttatgcaccactgaacatggattttaacttaaaatacttaagggcagatttttactgttagttttcttgactaacagagcaacccagtgcagttcctaaagacttctgattttgtgtagcaccagctcctgttgcattttctgaatgaattagtattaaaaatggagccccaagaagctggttaaatttttagccttctgcatttaagctgtagcccaggctgtgagctagtatcgcatcttattcattatccaacatagaaccaggtttacaacaggcactcaaaatgtttgtgggatgaatgaatgagaaactgccaattctggggatttctgtttcagaagagttgatgctaagctgttctttctaacaatggttcccaggttcagctgtttcagtccacaccttgttcacagtaagatattcaattcaattcagcaaacatttgttgtgtgcttgctgctctgtgcctgaccagaagaaatgaagccaagatacaaataatagaaccctgtcatgagcacagaaagacctgctgagtttctattgattgtggtaaaccagcctgcatccagttccaagtaacagctgcccacttagtgaatactctctcatgtttcaacactcagttctagtgtagcctcttctataaagcctttcttttccagatgcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458577 - DNA, 4037 bp, Homo sapiens
ggcacgaggggtggagcagcggcagcagcagcagccgccgccgccgccgccgctgccgccgccgccggaaagggagaggcaggagagcccgagacttggaaaccccaaagtgtccgcgaccctgcacggcagctcccttccagcttcatgggcaaagtgtggaaacagcagatgtaccctcagtacgccacctactattacccccagtatctgcaagccaagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtggcaaaggaaaccagagaaaacaagtatcggggctctgctatcaaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458578 - DNA, 3445 bp, Homo sapiens
tggtcgactctagacatccccctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458579 - DNA, 3375 bp, Homo sapiens
atgatgctctccaccattagtccaactgtcttgctagcaagatactacctgattcccgtggtacaacgttctggcttggaaaggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458580 - DNA, 3112 bp, Homo sapiens
agtgaccagtttgccaagaattctaactgccttaatctttttaatcattgatagtattgtttccttgttttctttctgtagatttttaacatgattaaaaagagttctaaagaaataggtaagctttacaatgaaaatcaatatttctttcaaaatcctcccttttctaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458581 - DNA, 3129 bp, Homo sapiens
attgttgtgaagtgaatgccaagatatcatttcccctaacgctcttaaaaaactctcaggaagagcaatttagaagatttttaggaaactgtttatgatgccatttgcaagattgaggaaggttgtttttgcttcacattcttaaacaaactaaggtatttcctttgtaaaaagtaattacaggatcttaactcttgcctcagtttgtctaattttgctcctgtctccaactccccagggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458582 - DNA, 3763 bp, Homo sapiens
gaaagtctattctctgggtatctctcctttacgagaatatagcacccacacgtgaccacatctagccttttatgactagtgtcatctatataactagtaccactgtccctgtggcagtgtcatgaagcgaaagacgaaggtaatacaagatggtaaaagcagggaattatttctcgcttatttcttcttttatggagtttgggagtattgaatcatggtcttaatattgaaatatttcaccaaagtccaggggactcctttgggtaatgaggttgagctggcaccagatcagcttccagatttgatgcttagcattttgctggtaagatggctaaaggattttaatttagcctctattctatagtggcttaaaagaacaaagggtggtgcgttttccccttatacactcaaaacctacagctgtttcttgtgaaggctaagccagggccacacatatccaatgagactgactagaaatttctcctgcctttgggaaaggatgactgtcagtgtcagaaaagccaggctctgctgcctaatctgcagtgacctgttagaggtctaataagtcttacccctgtgggctctacctgtagaaacaatactaggtactagtttagggggctgctagaaaataatgaggtcctttgaggagagatcttctaaaatcacacattagtgatactgaattattgagagtgacaaacttttttatcttcacccataataaactttttttatcttcactttgttagcaaatccaaagaaatgtggaatttttagtttagcagattcaaaaagtagaaaacagtttaccttccatatgacatatttatatgcactatttaagctttgaggtgtagcccatttaaatttcttctttgagatttccaaatacattatatccatctcacaatccccccacgtactccaaattttgcatggtttaccattgcccattctgacctcattcttctttctagtacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458583 - DNA, 2832 bp, Homo sapiens
ctctacatgacgtgaagaaatttactttaaagagtaactgtttttaaggcactgttggattcagtcaggcctaagtagcagagctgaggttttttcactaacatgtctcatccattctgctttgtttgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458584 - DNA, 3148 bp, Homo sapiens
  misc_feature (27)..(27): n is a, c, g, or t
ttacagaattgcgagctccggtacccngttcaattgtctacaccaacgtttagcaacatcttgattatgaatttagataaatgtcaatatccttagattgaaagattatattcccaactctcacttgaaccacaaatttcaaaacttttcactttaccatgcagactgtaataaaatagctgtgtagaacttagaataccctggtttctgcattgccctggtgatatagaataccttggtttctggattgccctggtgataacatgtatttttgatttcataaagtcactctttagagacccaaatgaatttggctctaaattagaaaagaaagtattttgcaagtcctggatgtgacaggcattgaaagtaaccatcagttccagagtctgcatttatcagtctaccatcagtgatgagcataacctttttcaaacacatatctctttaaaacaagaaacagattacaaagctctgtagtgtttccacacccaaatctaccaaaagcatttgtcttttatttttctcttccagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458585 - DNA, 2603 bp, Homo sapiens
tctagagtatacactcccggcaagcccaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458586 - DNA, 3935 bp, Homo sapiens
gttaaaaaccaaggacctgatatcttataattcagtttaagcctaatacagttcatgtaaactccttttttggcaatttaacatatacatggatcaagtttagtaggtttagaggaaaatgaatgtcttgttctgaaaaaatagcagtaccagctgagctttggggaggtgacagattgagtcacttcacagcttaattctgttatgaactggtcccatgggcatggattgtcaattagggagacttgaatcttttagatattaaatctacaggcagacaacaaagaacacattattcttttgtaaaaatagaggaacctggctgtctactacagaactagaggaacctagcttagacagaagctcatcccacttcagcacctacaacagatttgatacctttgagcaagattggatacttttctcaaagtaaatactgggttggtaccccagagttatgcaccactgaacatggattttaacttaaaatacttaagggcagatttttactgttagttttcttgactaacagagcaacccagtgcagttcctaaagacttctgattttgtgtagcaccagctcctgttgcattttctgaatgaattagtattaaaaatggagccccaagaagctggttaaatttttagccttctgcatttaagctgtagcccaggctgtgagctagtatcgcatcttattcattatccaacatagaaccaggtttacaacaggcactcaaaatgtttgtgggatgaatgaatgagaaactgccaattctggggatttctgtttcagaagagttgatgctaagctgttctttctaacaatggttcccaggttcagctgtttcagtccacaccttgttcacagtaagatattcaattcaattcagcaaacatttgttgtgtgcttgctgctctgtgcctgaccagaagaaatgaagccaagatacaaataatagaaccctgtcatgagcacagaaagacctgctgagtttctattgattgtggtaaaccagcctgcatccagttccaagtaacagctgcccacttagtgaatactctctcatgtttcaacactcagttctagtgtagcctcttctataaagcctttcttttccagatgcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458587 - DNA, 1662 bp, Homo sapiens
aatgaacccaaacacttccttcaccaaggggccctgcttttggacaccatgtgtcccaaaaattgaaacttaagataattgccgttagatataatacagaataggtgtgtacccttgcttttgtttattcttcagcaggaaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458588 - DNA, 930 bp, Homo sapiens
  misc_feature (50)..(50): n is a, c, g, or t
atcgagctcggcccttgtcatttaggttttataattttacctaatagagngagagagagagagagagagacagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458589 - DNA, 1811 bp, Homo sapiens
ggcacgaggggtggagcagcggcagcagcagcagccgccgccgccgccgccgctgccgccgccgccggaaagggagaggcaggagagcccgagacttggaaaccccaaagtgtccgcgaccctgcacggcagctcccttccagcttcatgggcaaagtgtggaaacagcagatgtaccctcagtacgccacctactattacccccagtatctgcaagccaagtttggaaggcattcgggaataccaagtgaaaaggaagagtgaagaacagaaaaatgttagtgggatggcaaacactgtgaacattgctgtttctagtgggccagaaaaatcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgaggtatgagggaaaggtcttcataactggggggctcaaatcaagcacaatctatagggctttttttaaaatcagaatggtgattgggataactcggattttatcatactgctttaatcgtggccaaggcatctagtcttgttgaaatattaaaatcagtgattttatgaatttaagattaatcattttgtctaaagagaatgctttatactgaagccaaatgtatactctccccactaaaaagaaaaaagataaaaatctgtaacatcagagaacaattttggttcttggtgttctctggtcgacgcggccgcgatttagtagtagta

SEQ ID NO: 458590 - DNA, 905 bp, Homo sapiens
  misc_feature (50)..(50): n is a, c, g, or t
atcgagctcggcccttgtcatttaggttttataattttacctaatagagngagagagagagagagagagacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458591 - DNA, 1102 bp, Homo sapiens
  misc_feature (1088)..(1088): n is a, c, g, or t
ggcacgaggggtggagcagcggcagcagcagcagccgccgccgccgccgccgctgccgccgccgccggaaagggagaggcaggagagcccgagacttggaaaccccaaagtgtccgcgaccctgcacggcagctcccttccagcttcatgggcaaagtgtggaaacagcagatgtaccctcagtacgccacctactattacccccagtatctgcaagccaagtttggaaggcattcgggaataccaagtgaaaaggaagagtgaagaacagaaaaatgttagtgggatggcaaacactgtgaacattgctgtttctagtgggccagaaaaatcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacgtaacncatactgccggtcc

SEQ ID NO: 458592 - DNA, 718 bp, Homo sapiens
ctttaagtgatctgtgactccttaagttgtttgcaaaatgttgcttgtgtgtgtgcaattaagtggggaaaaatgttctatttccctaattaggttttcagagggctccatgaccctaaagaggttaagaaccaatagtaaagagtttacaaaacattattattcccattttataattagaaaattgaggaatagaaattgacagcagctgatttgctgcttaagaaagaaaattagatgtcatagttccctaatcctgtaatgctataagctattagattattaagaccactgaagcatataaaaaatgggggcatctggcccaaattagggtctgtagggagttgtttgccttcccatcatatatccagtgagggccctgcactcatgttggagtgggcctttctccactaaaccaccataagcttatgcaattggatttgagaaattggcagctgcaagaaaccaccaaccccaatggggaaaggctacagtccagataactgaaatgttaacaaggcagaagcacttaactttggtctgccttaggtggcaaaggaaaccagagaaaacaagtatcggggctctgctatcaaggtaaatcgcaatacattcttcccccatgactcttccccatatcctctctgttgaacctctgaagttaacaataggggataaaatgcaggagggttttgttgttaagaattggaaactgaaa

SEQ ID NO: 458593 - DNA, 3989 bp, Homo sapiens
ggcacgaggggtggagcagcggcagcagcagcagccgccgccgccgccgccgctgccgccgccgccggaaagggagaggcaggagagcccgagacttggaaaccccaaagtgtccgcgaccctgcacggcagctcccttccagcttcatgggcaaagtgtggaaacagcagatgtaccctcagtacgccacctactattacccccagtatctgcaagccaagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458594 - DNA, 3466 bp, Homo sapiens
ggcacgaggggtggagcagcggcagcagcagcagccgccgccgccgccgccgctgccgccgccgccggaaagggagaggcaggagagcccgagacttggaaaccccaaagtgtccgcgaccctgcacggcagctcccttccagcttcatgggcaaagtgtggaaacagcagatgtaccctcagtacgccacctactattacccccagtatctgcaagccaagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcattttttttttttttttttgggggaaaattttatgaaaaaattttttagaggttttaggggggggggaaagggggggg

SEQ ID NO: 458595 - DNA, 4147 bp, Homo sapiens
ggcacgaggggtggagcagcggcagcagcagcagccgccgccgccgccgccgctgccgccgccgccggaaagggagaggcaggagagcccgagacttggaaaccccaaagtgtccgcgaccctgcacggcagctcccttccagcttcatgggcaaagtgtggaaacagcagatgtaccctcagtacgccacctactattacccccagtatctgcaagccaagtttggaaggcattcgggaataccaagtgaaaaggaagagtgaagaacagaaaaatgttagtgggatggcaaacactgtgaacattgctgtttctagtgggccagaaaaatcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtggcaaaggaaaccagagaaaacaagtatcggggctctgctatcaaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaatatgtagtaggtgtttttaatgatttttcacataatgtgtaaggtagtgaaatgcaagaagggaaaaatgttttgtgtgaaacacattttctgactggggaacttttattagggtaaattgtttgtaaggctgtacgccaacagtttcctctgatagtttgactgatttaggatatctgctgtatgatgcaatgtaaagtcttttttgccttttttcaggaaaaaaaaaaaagctaacttgatgtactagatttagtgtaggtagtgttggggttggggatgggggtgggggaggggagtcactgaatgttttgtccttcctttatactaatgatagtgctttagaatgagaattatgcctgaaatctggcaaaccgaaaaatgttgctattgcaacaaagtggcaaaagctaaaagtaaggatttatcttcaaacataagctgagataacgaatagaagcaaaacgattggctactagctctctctctctctctctattaggtaaatttgaaaaataaaaatgacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgagaagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctagaaatgtctgaactaagtgccatactcgtctgggtaagatttgggaaacataacctctgtacataaaaaaaaaaaaatcagttaaacatcacatagtagacagccattaaattataaaaaaattaatttatgaagaaagaccttttgtacagattgaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaatttta

SEQ ID NO: 458596 - DNA, 2834 bp, Homo sapiens
ggcacgaggggtggagcagcggcagcagcagcagccgccgccgccgccgccgctgccgccgccgccggaaagggagaggcaggagagcccgagacttggaaaccccaaagtgtccgcgaccctgcacggcagctcccttccagcttcatgggcaaagtgtggaaacagcagatgtaccctcagtacgccacctactattacccccagtatctgcaagccaagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaaaaaaaacaaaaaaaaaacaaaaaaaaaaaaaaaaaaaaaaaagaaaagaaaaaaaaaaaagaaaaaaaaaagaaacaaaagagggcggagcggcgaccgaaaagtacatcactcctacgggcggcgcgcacggtcacacaccccgacccgcccgccctgatttctgtacgagagaggccgcgccccatacgatagagcggtgtcagcttataagacagcgagagcgagcaggcgcgcatcacataacacacagccccgcggcgggcgagaaacagacagcatgcaagaggcgcgcgacctaaccggccagaccgcaaagacccacactacccgggcggcgggcgcgcgaaccactaacacgagggcaacagacacacctccacgcaacgccgatcagtcatcacgacacaccgcgcggacgcgagagcacacacagctcaccagctgggcggcatcgatatgctacgcacggctgacactacgcccgagccccgaacagacaaacggcgacgcggcgaccgggaacgaccaagcgtccccgaggcagaccacacgcgcctccccgcaccagcacacttcacacgagcggagccgaacgccacgacgaaaagaagcgcccgcccgccaccgcagaagcaaacgccgaccaccaacgaccgcgagcacagccccggcacccgcagcacggaccagcgc

SEQ ID NO: 458597 - DNA, 2224 bp, Homo sapiens
ggcacgaggggtggagcagcggcagcagcagcagccgccgccgccgccgccgctgccgccgccgccggaaagggagaggcaggagagcccgagacttggaaaccccaaagtgtccgcgaccctgcacggcagctcccttccagcttcatgggcaaagtgtggaaacagcagatgtaccctcagtacgccacctactattacccccagtatctgcaagccaagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaccaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctggtggaagggaggaatcacgccgcttaaagtttgacttattggataagtgtgttccaattgttcctacgggcggtcaaccacgtatgtgtatttgggatcaagagattcaagatgctcagaatttcgctgttttagctgctcaagttattggcttgcatctagattttttaagacaaggcgaaacctcgaactagattactcttttgatcctctatctaaccagaccttaaagatggagttcttgcaaagccgttaaatgtatctgaaaccgtttaccgtgctttgcaaactaaactatgtacgtatcatgaattgaatacgtgcataggtcttgaaggtgcgatgaggatcatagaaatcgggcaagtagccacgtactatgaacaaagattaatttctgctatcagataagagggctcgtgaa

SEQ ID NO: 458598 - DNA, 1563 bp, Homo sapiens
ggcacgaggggtggagcagcggcagcagcagcagccgccgccgccgccgccgctgccgccgccgccggaaagggagaggcaggagagcccgagacttggaaaccccaaagtgtccgcgaccctgcacggcagctcccttccagcttcatgggcaaagtgtggaaacagcagatgtaccctcagtacgccacctactattacccccagtatctgcaagccaagtttggaaggcattcgggaataccaagtgaaaaggaagagtgaagaacagaaaaatgttagtgggatggcaaacactgtgaacattgctgtttctagtgggccagaaaaatcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctgtaagttttttatcttaatgactttgtgttttacaagtaagttatgtgtatattctctctaggttaaaaccatttgccaagggtggtataggatttgggaaattttaaacatggaatatgagaatgtacaatttcattataaaacttcttctcatccttataaaacaacttggtagaagatattaagttacattttctataagaacttaaaatatatcatatttgaggcagggcaccattttcttattcataccagctctttagagatcattcaaatgagaggctacatttttaatagtacttgggataaaaccgctctcattttttacattctgtttaatgcagatataaagtt

SEQ ID NO: 458599 - DNA, 9139 bp, Homo sapiens
  misc_feature (3)..(3): n is a, c, g, or t
cgnccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggactgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggcgtgtgaccccctgccgcacgaggaggagccctctgaagtgccacagctgcgccagccctacgctcctccccggcccggcgcccgccccacacactgggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgca

SEQ ID NO: 458600 - DNA, 9355 bp, Homo sapiens
  misc_feature (3)..(3): n is a, c, g, or t
cgnccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggactgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgcaaaaaaaaaaaaaagcaaaaaaaacaaaaaagggggggggggaaaaagaacccgcaggggcccaggctcagcggtccccgcttttggtcacacgggcccaaaggggaggcggaataaagcagcgcggcgggcgtacccggctgacggcacacggcctctggccttgggagacccccctgtgggtcctcggcacgccacaggttaggctggaaatacttaggataggtccaccctgccgcgaatcgcgatgatcgcacacgcagaaaggaagagagaacacaacggacacgcaggcacacagaacggtccgcacagt

SEQ ID NO: 458601 - DNA, 7621 bp, Homo sapiens
  misc_feature (3)..(3): n is a, c, g, or t
cgnccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggactgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgca

SEQ ID NO: 458602 - DNA, 2466 bp, Homo sapiens
cggacgcgtgggcgaccacgcgtgaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgca

SEQ ID NO: 458603 - DNA, 8266 bp, Homo sapiens
  misc_feature (3)..(3): n is a, c, g, or t
cgnccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggactgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgca

SEQ ID NO: 458604 - DNA, 7707 bp, Homo sapiens
  misc_feature (3)..(3): n is a, c, g, or t
cgnccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggactgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccccatggggggccttttttacacactgcgaggcccagctttctaggggacttttgcacatgtcatgcagctcagctgggagctgcttaggtggaaaactccaaataaagtgcggctgtcgca

SEQ ID NO: 458605 - DNA, 2024 bp, Homo sapiens
  misc_feature (3)..(3): n is a, c, g, or t
cgnccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtg

SEQ ID NO: 458606 - DNA, 276 bp, Homo sapiens
gggctttccgagggacacacattccaggtggcagagttcatcgtggacactcgcaatgcaggtacctcctgccccagagagcccccattccagcgggtgcctcccacaggcacttgtcctcgtcctgcccagcacccccttggccgcactctctcctccctgaaacttcctgaccagtctgcgtcaggattcgcattctggggccccttgcgggaaagtgaatggccccgcatcagttctctcccttttaagagaaagctcagctgtcctgagttt

SEQ ID NO: 458607 - DNA, 9040 bp, Homo sapiens
  misc_feature (3)..(3): n is a, c, g, or t
cgnccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggactgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgca

SEQ ID NO: 458608 - DNA, 9130 bp, Homo sapiens
  misc_feature (3)..(3): n is a, c, g, or t
cgnccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgtggtcccagctcacacacacctgccccgggggtggggcaagctggttctcctcccctccccaactcagccttcttccctccgcacaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggactgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgca

SEQ ID NO: 458609 - DNA, 3215 bp, Homo sapiens
ttaagttgaataaaacacctattcctcaaaccaagttttagacaactggccttgaagaaggtgttgaatatgaatttagagtcgctgcagagaacatcgtgggcattggcaagccgagtagccaagattagtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtgcccacatccctggaagtcccttcaagatccgcgttggggagcagagccaggctggggacccaggcttggtgtcagcctacggtcctgggctcgagggaggcactaccggtgtgtcatcagagttcatcgtgaacaccctgaatgccggctcgggggccttgtctgtcaccattgatggcccctccaaggtgcagctggactgtcgggagtgtcctgagggccatgtggtcacttatactcccatggcccctggcaactacctcattgccatcaagtacggtggcccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgca

SEQ ID NO: 458610 - DNA, 1213 bp, Homo sapiens
cggacgcgtgggcgaccacgcgtccccagcacatcgtgggcagccccttcaaggccaaggtcactggtccgaggctgtccggaggccacagccttcacgaaacatccacggttctggtggagactgtgaccaagtcctcctcaagccggggctccagctacagctccatccccaagttctcctcagatgccagcaaggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgca

SEQ ID NO: 458611 - DNA, 1049 bp, Homo sapiens
  misc_feature (25)..(26): n is a, c, g, or t
gtgaggtgatctagaggatcccttnngtgatgggtggtgactcggggccctgggctgtcccaggccttcgtgggccagaagaactccttcaccgtggactgcagcaaagcaggcaccaacatgatgatggtgggcgtgcacggccccaagaccccctgtgaggaggtgtacgtgaagcacatggggaaccgggtgtacaatgtcacctacactgtcaaggagaaaggggactacatcctcattgtcaagtggggtgacgaaagtgtccctggaagccccttcaaagtcaaggtcccttgaatcccaaaagtgcctccccagcctcagcccccacctccagccacacacacattacacacacacacacacacacacaaatgtgccacacccagacacgcacagaatcagacactacaaacacctgccttgggggtgaagtgaaggcccagcctccccaccccaccgcgccccaggggttggaggaccttgtctgtgtcaggacagtgtccctccctgggaatgtgacatgagggccgactggggccaggctcaggggcagaggctgggacacaaggggctggcgagggctgcgaggccagggaagccctgagtttctggcggggctgagcagtgggggagcattgtgttgtgggtgtctgtgtgtgaggtcaccctcaaactgcaccgccggccagataccctcctgaccccgaggacttggtctggtctctctggtggctacaaccccagagttttaaggacttggaaaggaaagcacaatcagagaagaaaacagcccccgaaccagcaggagtggcctggcacatggaccggcctgagcgatgtgcactccacccaagccaggctcccagggggcctgatttctctctcactgtctctttttttaaaatggttgcacggctctgccccatggggggccttttttacacactgcgaggcccagctttctaggggacttttgcacatgtcatgcagctcagctgggagctgcttaggtggaaaactccaaataaagtgcggctgtcgca

SEQ ID NO: 458612 - DNA, 7687 bp, Homo sapiens
  misc_feature (3)..(3): n is a, c, g, or t
cgnccctggagggagagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccatagacagcaaggccatcgtggatgggaacctgaagctgatcctgggcctgatctggacgctgatcctgcactactccatctccatgcccatgtgggaggatgaagatgatgaggatgcccgcaaacagacgcccaagcagcggctgcttggctggatccagaacaaggtgccccagctgcccatcaccaacttcaaccgtgactggcaggacggcaaagctctgggcgccctggtggacaactgcgcccccggtctctgccccgactgggaggcctgggaccccaaccagcccgtggagaacgcccgggaggccatgcagcaggccgacgactggcttggggtgccccaggtcattgcccctgaggagattgtggaccccaacgtggatgagcattctgttatgacctacctgtcccagttccccaaggccaagctcaaacctggtgcccctgttcgatccaagcagctgaaccccaagaaagccatcgcctatgggcctggcatcgagccacagggcaacaccgtgctgcagcctgcccacttcaccgtgcagacggtggacgcgggcgtgggcgaggtgctggtctacatcgaggaccctgaaggccacaccgaggaggctaaggtggttcccaacaatgacaaggatcgcacctatgctgtctcctatgtgcccaaggtcgctgggttacacaaggtgaccgtgctctttgctggccagaacattgaacgcagtccctttgaggtgaacgtgggcatggccctgggagatgccaacaaggtgtcagcccgtggccctggcctggaacctgtgggcaatgtggccaacaaacccacctactttgacatctacactgcgggggccggcactggcgatgttgctgtggtgatcgtggacccacagggccggcgggacacagtggaggtggccctggaggacaagggtgacagcacgttccgctgcacatacagacctgccatggaggggccacataccgtgcatgtggcctttgcgggtgcccccatcacccgcagtcccttccctgtccatgtgtcggaagcctgtaaccccaacgcctgccgcgcctctgggcgaggcctgcagcccaagggtgttcgcgtgaaagaggtggctgacttcaaggtgtttaccaagggtgccggcagcggggagctcaaggtcacggtcaaggggccaaagggcacagaggagccagtgaaggtgcgggaggctggggatggtgtgttcgagtgcgagtactacccggtggtgcctgggaagtatgtggtgaccatcacgtggggcggctacgccatccctcgcagcccctttgaggtacaggtgagcccagaggcaggagtgcaaaaggtccgggcctggggtcctggtttggagactggccaggtgggcaagtcagccgattttgtggtggaagccattggcaccgaggtggggacactgggcttctccatcgaggggccctcacaagccaagatcgaatgtgacgacaagggggatggctcctgcgatgtgcggtactggcccacggagcctggggagtacgctgtgcacgtcatctgtgacgatgaggacatccgagactcacccttcattgcccacatcctgcccgccccacctgactgcttcccagataaggtgaaggcctttgggcctggcctggagcctaccggctgcatcgtggacaagcccgctgagttcaccattgatgctcgtgcagctggcaagggagacctgaagctctatgcccaggacgccgacggctgtcccatcgacatcaaggtgatccccaacggcgacggcaccttccgctgctcctacgtgcccaccaagcccattaagcacaccatcatcatctcctggggaggcgtaaacgtgcccaagagccccttccgggtgaacgtgggcgagggcagccaccccgagcgggtaaaggtgtacggccccggagtggagaagacaggcctcaaggccaatgagcccacctacttcacggtggactgcagcgaggcggggcaaggcgacgtgagcatcggcatcaagtgcgccccaggcgtggtgggccctgcagaggctgacattgacttcgacatcatcaagaatgacaacgacaccttcaccgtcaagtacacgccaccaggggcgggccgctacaccatcatggtgctgtttgccaaccaggagatccccgccagccccttccacatcaaggtggacccatcccacgatgccagcaaagtcaaggccgagggccctgggctgaatcgcacaggtgtggaagtcgggaagcccacccacttcacggtgctgaccaagggagccggcaaggccaagctggatgtgcagtttgcagggacagccaagggcgaggttgtgcgggactttgagatcatagacaaccatgactactcctacactgtcaagtacaccgctgtccagcagggcaacatggcagtgacagtgacttatggcggggaccctgtccccaagagcccctttgtggtgaatgtggcacccccgctggacctcagcaaaatcaaagttcagggccttaatagcaaggtggctgtgggacaggaacaagcattctctgtgaacacacgaggggctggcggtcagggccaactggatgtgcggatgacttcgccctctcgccggcccatcccctgcaagctggagccaggcggtggagcggaagcccaggctgtgcgctacatgcccccggaggaggggccctacaaggtggatatcacctacgatggtcacccggtgcctggcagcccgtttgctgtggagggtgtcctgccccctgatccctccaaggtctgtgcttatggcccgggtctcaagggtggactggtaggcacccccgcgccattctccatcgacaccaagggggctggcacaggtggcctggggctgaccgtagagggcccctgcgaggccaagatcgagtgccaggacaatggtgatggctcatgtgctgtcagctacctgcccacggagcctggcgagtacaccatcaacatcctgtttgctgaggcccacatccctggctcgcccttcaaagccaccattcggcctgtgtttgacccgagcaaggtgcgggccagtggaccgggcctggagcgcggcaaggtcggtgaggcagccaccttcactgtggactgctcagaggcaggcgaggcggagctgaccattgagatcctgtcggatgccggggtcaaggccgaggtgctgatccacaacaacgcggatggcacctaccacatcacctacagccctgccttccctggcacctacaccattaccatcaagtatggcgggcatcccgtgcccaaattccccacccgtgtccatgtgcagcctgcggtcgataccagtggcgtcaaggtctcagggcctggtgttgagccacacggtgtcctgcgggaggtgaccactgagttcactgtggatgcaagatccctaacagccacaggcggcaaccacgtgacggctcgtgtgctcaacccctcgggggccaagacagacacctatgtgacagacaatggggacggcacctaccgagtgcagtacaccgcctacgaggagggcgtgcatctggtggaggtcctgtatgatgaggtcgctgtgcccaagagccccttccgagtgggcgtgaccgagggctgtgatcccacccgcgtccgagccttcgggccaggcctggagggtggcttggtcaacaaggccaaccgattcactgtggagaccaggggagcgggcaccgggggccttggcctagccatcgagggtccctcggaagccaagatgtcctgcaaggacaacaaggatggtagctgcaccgtggagtacatccccttcactcctggagactatgacgtcaacatcaccttcggggggcggcccatcccagggagcccgttccgcgtgccagtgaaggatgtggtggaccctgggaaggtgaagtgctcagggccagggctgggggctggtgtcagggcccgggttcctcagaccttcacagtggactgcagtcaagctggccgggcgcccctgcaggtggctgtgctgggccccacaggtgtggccgagcctgtggaggtgcgggacaatggagatggcacccacactgtccactacaccccagccactgacgggccctacacggtagccgtcaagtatgctgaccaggaggtgccacgcagccccttcaagatcaaggtcctcccagctcatgatgccagcaaggtgcgggccagcggcccaggcctcaacgcctctggcatccctgccagcctgcctgtggagttcaccatcgacgcacgggacgcgggcgaggggttgctcactgtccagatcttggaccccgagggtaagcccaagaaggccaacatccgggacaatggggatggcacgtacactgtgtcctacctgccggacatgagtggccggtacaccatcaccatcaagtatggcggtgatgagatcccctactcgcccttccgcatccatgctctgcccactggggatgccagcaagtgcctcgtcacagtgtccattggaggccatggcctgggtgcctgcctgggccctcgaatccagattgggcaggagacggtgatcacggtggatgccaaggcagccggtgaggggaaggtgacatgcacggtgtccacgccggatggggcagagctcgatgtggatgtggttgagaaccatgacggtacctttgacatctactacacagcgcccgagccgggcaagtacgtcatcaccatccgcttcgggggtgagcacatccccaacagccccttccacgtgctggccacagaggagccagtggtgcctgtggagccaatggagtccatgctgaggcccttcaacctggtcatccccttcgcggtgcagaaaggggagctcacaggagaggtgcggatgccctcggggaagacggcacggcccaacatcaccgacaacaaggacggcaccatcacggtgaggtatgcacccactgagaaaggcctgcaccagatggggatcaagtatgacggcaaccacatccctgggagccccttacagttctatgtggatgccatcaacagccgccatgtcagtgcctatgggccaggcctgagccatggcatggtcaacaagccagccaccttcactattgtcaccaaagatgctggagaagggggtctgtcactggccgtggagggcccatccaaggcagagatcacctgtaaggacaacaaggatggcacctgcaccgtgtcctatctgccgactgcgcctggagactacagcatcatcgtgcgcttcgatgacaagcacatcccggggagccccttcacagccaagatcacaggtgatgactccatgaggacctcacagctgaatgtgggcacctccacggacgtgtcactgaagatcaccgagagtgatctgagccagctgaccgccagcatccgtgccccctcgggcaacgaggagccctgcctgctgaagcgcctgcccaaccggcacattgggatctccttcacccccaaggaggtcggggagcacgtggtgagcgtgcgcaagagtggcaagcatgtcaccaacagccccttcaagatcctggtggggccatctgagatcggggacgccagcaaggtgcgggtctggggcaaggggctttccgagggacacacattccaggtggcagagttcatcgtggacactcgcaatgcaggttatgggggcttggggctgagtattgaaggcccaagcaaggtggacatcaactgtgaggacatggaggacgggacatgcaaagtcacctactgccccaccgagcccggcacctacatcatcaacatcaagtttgctgacaagcacgtgcctggaagccccttcactgtgaaggtgaccggcgagggccgcatgaaggagagcatcacccggcggagacaggcaccttccatcgccaccatcggcagcacctgtgacctcaacctcaagatcccaggaaactggttccagatggtgtctgcccaggagcgcctgacacgcaccttcacacgcagcagccacacctacacccgcacggagcgcacggagatcagcaagacgcggggcggggagacaaagcgcgaggtgcgggtggaggagtccacccaggtcggcggggaccccttccctgctgtgtttggggacttcctgggccgggagcgcctgggatccttcggcagcatcacccggcagcaggagggtgaggccagctctcaggacatgactgcacaggtgaccagcccatcgggcaaggtggaagccgcagagatcgtcgagggcgaggacagcgcctacagcgtgcgctttgtgccccaggaaatggggccccatacggtcgctgtcaagtaccgtggccagcacgtgcccggcagcccctttcagttcactgtggggccgctgggtgaaggtggtgcccacaaggtgcgggccggaggcacagggctggagcgaggtgtggccggcgtgccagccgagttcagcatctggacccgggaggctggcgctgggggcctgtccattgctgtggagggtcctagcaaagcggagattgcatttgaggatcgcaaagatggctcctgcggcgtctcctatgtcgtccaggaaccaggtgactatgaggtctccatcaagttcaatgatgagcacatcccagacagcccctttgtggtgcctgtggcctccctctcggatgacgctcgccgtctcactgtcaccagcctccaggagacggggctcaaggtgaaccagccagcgtcctttgccgtgcagctgaacggtgcccggggcgtgattgatgcccgggtgcacacaccctcgggggctgtggaggagtgctacgtctctgagctggacagtgacaagcacaccatccgcttcatcccccacgagaatggcgtccactccatcgatgtcaagttcaacggtcccatggggggccttttttacacactgcgaggcccagctttctaggggacttttgcacatgtcatgcagctcagctgggagctgcttaggtggaaaactccaaataaagtgcggctgtcgca

SEQ ID NO: 458613 - DNA, 2317 bp, Homo sapiens
agcggaaggacctttctgtcctggttccctgaagcatcgagagggaaccgcggccggcaggccggaccgctccggagaggaggcagcggcagtttgagcccctgtaaatgttatatgtgtacttttttttactatgtggcgtcgaagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458614 - DNA, 831 bp, Homo sapiens
  misc_feature (28)..(30): n is a, c, g, or t
acttaggctaggtacgagggctgggggnnnttaagggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaggattgggattctccgatggggtgaacctctcgggggggcgtggggtgcgccgg

SEQ ID NO: 458615 - DNA, 457 bp, Homo sapiens
  misc_feature (18)..(18): n is a, c, g, or t
tcgtgccgaattcggcangacaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458616 - DNA, 2332 bp, Homo sapiens
cccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagcctgtggacattttcgcggtccgggtccctgcggcggacgggtcggatcgtgctcgtggccagggcgcagtcaggtgtcgcgtggtcctgatctaggaagagactgcggccttatcaccgtctcggtgtctgctttcaccttcaactgcccccctcctcacctggaccgctcaccctcctcctcccctctcaccccgccatccccaccagtccccacctgtctctgtagactgcaagactcatcaagtgacttgctgagcaaaccctgccgagaagagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458617 - DNA, 1995 bp, Homo sapiens
agcggaaggacctttctgtcctggttccctgaagcatcgagagggaaccgcggccggcaggccggaccgctccggagaggaggcagcggcagtttgagcccctattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458618 - DNA, 2018 bp, Homo sapiens
cccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458619 - DNA, 1944 bp, Homo sapiens
cccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458620 - DNA, 1596 bp, Homo sapiens
cccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaggattgggattctccgatggggtgaacctctcgggggggcgtggggtgcgccgg

SEQ ID NO: 458621 - DNA, 1656 bp, Homo sapiens
agagtaaaacgagtcagagatatcgtatgcgtgggtatgaagaagtggtgagttatacagaccgataagaatatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458622 - DNA, 1290 bp, Homo sapiens
aaacttacggctaggtacgaggcgggtgttgttaagggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458623 - DNA, 1289 bp, Homo sapiens
  misc_feature (28)..(30): n is a, c, g, or t
acttaggctaggtacgagggctgggggnnnttaagggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458624 - DNA, 1092 bp, Homo sapiens
cccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagaaagaagttaaaaagaagaggtgggtcagacataag

SEQ ID NO: 458625 - DNA, 722 bp, Homo sapiens
ggatccagtcgaacggagactctcacgctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458626 - DNA, 637 bp, Homo sapiens
  misc_feature (25)..(25): n is a, c, g, or t
agtgcgacggagactctctcagganatgttttctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458627 - DNA, 1228 bp, Homo sapiens
  misc_feature (1158)..(1158): n is a, c, g, or t
  misc_feature (1162)..(1162): n is a, c, g, or t
  misc_feature (1218)..(1218): n is a, c, g, or t
cccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgantganataccattctagatatcgatttcttctatactgttttccacagaatgagatccaanatgggaaaaa

SEQ ID NO: 458628 - DNA, 287 bp, Homo sapiens
ccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggtagcagacacccacccacctattccccatccttctccaagggaaaaaaattttaagttgtattctcccatcatttgaatgattttagtttcaagacctacttcctattttgtttggaggga

SEQ ID NO: 458629 - DNA, 654 bp, Homo sapiens
aaactgaatcagaacctaacctggcaggcactaaatacccattttaatttagattttcttcttttctcctttaagtcttgaactgagagtcccatttctagatcatcgattttcttcctattacttgtctctgccaccagaaatgagaattccaaagaaaggtaggtaaatcaactcaaggtaaaactgtccattgccatcagattatatttgtaatttttacctgatgctcctttttttgtcacgtcagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggtataatgtctttaaaaacattttcaggaataagacagtttggatgcagagctgtcattgctgttcattttgtatttagtttgaatgatacatgtatttagtttgaatgatacatgtatttagtttgaatgatacatacatcagatatctctctgataggatgtccctatcagagagattcagagtctctgtaaacaattatctcttttgtaagaattacgtaagaattaagtagcatgaaggattat

SEQ ID NO: 458630 - DNA, 665 bp, Homo sapiens
ttttcttcttttctcctttaagtcttgaactgagagtcccatttctagatcatcgattttcttcctattacttgtctctgccaccagaaatgagaattccaaagaaaggtaggtaaatcaactcaaggtaaaactgtccattgccatcagattatatttgtaatttttacctgatgctcctttttttgtcacgtcagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggtataatgtctttaaaaacattttcaggaataagacagtttggatgcagagctgtcattgctgttcattttgtatttagtttgaatgatacatgtatttagtttgaatgatacatgtatttagtttgaatgatacatacatcagatatctctctgataggatgtccctatcagagagattcagagtctctgtaaacaattatctcttttgtaagaattacgtaagaattaagtagcatgaaggattataaagtagcatctagaatcgagagagagaggagacttactactaatcatcactgattttcattta

SEQ ID NO: 458631 - DNA, 2054 bp, Homo sapiens
cccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458632 - DNA, 663 bp, Homo sapiens
atgcaatgatggcaaatgcagcccagaaaatctctttgggtatcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458633 - DNA, 1211 bp, Homo sapiens
tgggaggccggaaggcgggcgcgcacggcggagaggcgggcgggaggccggagcatataaatgaaaagtgccataaactgaaaaaccaaacatgagggtagcagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggtttgagatagaaactgtgaagaacaactcaggatcctttgaaagcgtaaaaaacttgtgtaccacacaggtgtgggcaaaaagaggggagaccccagggtgtgggccatgtgtgaagctaataaaccgaggaattctccgaaatgtgtgggtaaaaccacatagtggcagaaagagggaacatcgagagcgaagcagacgtacttcacaggcgagcgacgatctctataataacaggagcggatgatgatagcagacaagagactgtgatctctgtttctctctgtgttgttctgttatctatcttctttctctctcgttctgtgcttcagcagatgagggagagcacagcagaggggaaaacagaagagacag

SEQ ID NO: 458634 - DNA, 2128 bp, Homo sapiens
cccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggattggagagggagaaagaaaaactgctttgtgtgccaaaagcaaaactcttggtgtttttgtttgtgaaataggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458635 - DNA, 2645 bp, Homo sapiens
cccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggtataatgtctttaaaaacattttcaggaataagacagtttggatgcagagctgtcattgctgttcattttgtatttagtttgaatgatacatgtatttagtttgaatgatacatgtatttagtttgaatgatacatacatcagatatctctctgataggatgtccctatcagagagattcagagtctctgtaaacaattatctcttttgtaagaattacgtaagaattaagtagcatgaaggattataaagtagcatctagaatcgagagagagaggagacttactactaatcatcactgattttcatttatcagatttttgggcacctgctgggtgccagatcttgttaggcacaaatgactaaaacagagccaccaagtattaaaaatatgcatatgagtgttctttaaaaggcactgcagctatccatattatgaatactttagcattttctaagtgatgggtgattcaaagggtctcatacaagttacagtcacgtcttaacattttctgtttcgtgaaatgagactaaacacaagtatttcctgccattttaagccattttgctcttatatgcttattcttacaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458636 - DNA, 1980 bp, Homo sapiens
cccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagattttcttcaatcacatctgaataaatcacttgaagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458637 - DNA, 1578 bp, Homo sapiens
cccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaaggttatttccagtcaagaccctgtaagatgaccaccgt

SEQ ID NO: 458638 - DNA, 1721 bp, Homo sapiens
cccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggtaaccactctgaagtggagggatattcatgctatattaagaaaagtatgaattgtttgactattttctatcatctttcagtatgacagtgatatttttgagtatcttgtgaggttacaaaagggaatctgatagtgtttgctttctatctcttggggaagaaagaaattttaatgtgtcagataatttttattctttaaaactagttacagctgggtatgagggctcatgctcatacccccagctgctgaggaggctgaggtgggaggatcacctgaacccaggagattgaggctgcagtgagctgtgattgcaccactgcactcctgcctggttgacagagtaagaccccgtctcttaaaa

SEQ ID NO: 458639 - DNA, 1236 bp, Homo sapiens
agagtatataagcttctgtaccccacttcattcggacgcgtgggtcgacccacgcgtccgggagaaactctttccaggtttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458640 - DNA, 1044 bp, Homo sapiens
cccgcccctgtgcgcgctggttggtcctcgcaggcatgatgaaacttcccgcacgcgttacaggagccaggtcggtataagcgccagcggcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggtttgggcttgcaccgtgcagaggccccccggggtcctttcctactgtgccgcacactttggtgccccacaggtgggcgctctccgggggggacccctcggtgtggccccgtgcctctaaccgctgttctcccttctgtggacgcccttt

SEQ ID NO: 458641 - DNA, 632 bp, Homo sapiens
  misc_feature (27)..(27): n is a, c, g, or t
atccgatactcgatagatcgaactacngctgccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaacaaaaaagtaaacat

SEQ ID NO: 458642 - DNA, 577 bp, Homo sapiens
atcatcttgaagcccccgtctgaaagttgcccagagccagtgcctcacctgctgttccttgttcactttttcacgggaggccttgcagggctttatgacaagattttatgggtggctgcccagcatcattgtgactcgtgagacagagagaaaccagttgtaaccatgtagacagtggaagtgatagggagaaaagagacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctggtaaggaggccctcgcgggtgccctggggagctcctctacctgctctgctgtgatgttttttcctaagtagaaactgaagcgctcctcttccaaaatacagagactcactgtgttagtctgtttttgcgttactaataaaggcgtacctgagactcggtaatttgtaaa

SEQ ID NO: 458643 - DNA, 542 bp, Homo sapiens
aggcgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctgtaagtatccacgtggccggtaccagtcttgctcttcctttgctgcaggcctttttagtcaagactcctttcgcctcagggtttagtataataataaatcaatgtagcagaggtttatgacgcgattgtttcctatagtaaaggcattagagacttatagtaatagctcatttttccaccattatagaagggctcaggtttcagtttctg

SEQ ID NO: 458644 - DNA, 3536 bp, Homo sapiens
aggcgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaaataaaaacaaaaaaagcaaggtgttttggtataataccttttcaggtgtgtgtggatacgtggctgcatgaccgggtgggtgggggggagtgtctcagggtcttctgtgacctcacagaactgtcagactgtacagttttccaacttgccatattcatgatgggtttgcattttagctgcaacaataaaatttttttctaaagaacataaattt

SEQ ID NO: 458645 - DNA, 4684 bp, Homo sapiens
aggcgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacagggtatgtttccactgacagacgcgctggcgagatgctcgtgtgcagagagcactggccgctagcccgatggtaggattcagttctgtggtgcatctgagccagtctcagaagaaacagatcaaaggtttttaaagtctggaactgtggaagggctaacaagagaattaaggatcgatgcactggggttttaaggagccctctggtcccaagaatataagagtctaatctcagggccttaacctattcaggagtaagtagagaaaatgccaaatacgtctgtttctctctctctttttttttttattcctttgtttttggaaaaaaatagaattacaacacattgttgtttttaacctttataaaaagcagctttttgttatttctggaacaaaaaaaaacaaagtaggcacttatgaaactttctcatacccttaggtgatgtaatcagccatataatttatatttgatttcccagggaaggaatcccaaacttttacgaatgtaaactcccttggagaagagggttaggacgctgttgcgctcaagcccccctcagctgtgtgcacactgagccaggacagggtctttgagctttcccactataagaagaacagcaacaaaaggccgtctagaaaaacagaacctgcctctgcttctgctcagggtgtccccgctgggtttccattgtcctttctccattgctccctcctgtggacagccatcttgctcatgtaccagccctcatcaccccatccccataaatgggtgtcctcgaggcctctgcctgggggtcagaggtcaccacagggtggccattggcatgtcaacccgctgttaattcagagaagtgggctccacctcattgggagaagtgccatttcagcagaaattcacacgttagacgtgtgttgctgttaagtaaggggaagagagaggactagcctcagagctctggccatggaaatgacctcctaagactttttcgtggttttaaatattttacctctttccaggtggcatctgagtacatcagatggttttgcaaaatgcaaacaattttttccttggggatgatttttggggagagggggctactgtaaaaaataaaaccaaaaccccctttgctccctcggaggttgaagttgccggggggtgtggccggggtcatgcatgaggcgacagctctgcaggtgcgggtctgggctcatctgaactgtttggtttcattccagttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaaataaaaacaaaaaaagcaaggtgttttggtataataccttttcaggtgtgtgtggatacgtggctgcatgaccgggtgggtgggggggagtgtctcagggtcttctgtgacctcacagaactgtcagactgtacagttttccaacttgccatattcatgatgggtttgcattttagctgcaacaataaaatttttttctaaagaacataaattt

SEQ ID NO: 458646 - DNA, 2079 bp, Homo sapiens
aggcgtgatgcgtagttccggctgccggttgacatgaagaagcagcagcggctagggcggcggtagctgcaggggtcggggattgcagcgggcctcggggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaaataaaaacaaaaaaagcaaggtgttttggtataataccttttcaggtgtgtgtggatacgtggctgcatgaccgggtgggtgggggggagtgtctcagggtcttctgtgacctcacagaactgtcagactgtacagttttccaacttgccatattcatgatgggtttgcattttagctgcaacaataaaatttttttctaaagaacataaattt

SEQ ID NO: 458647 - DNA, 2346 bp, Homo sapiens
aggcgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacagggtatgtttccactgacagacgcgctggcgagatgctcgtgtgcagagagcactggccgctagcccgatggtaggattcagttctgtggtgcatctgagccagtctcagaagaaacagatcaaaggtttttaaagtctggaactgtggaagggctaacaagagaattaaggatcgatgcactggggttttaaggagccctctggtcccaagaatataagagtctaatctcagggccttaacctattcaggagtaagtagagaaaatgccaaatacgtctgtttctctctctctttttttttttattcctttgtttttggaaaaaaatagaattacaacacattgttgtttttaacctttataaaaagcagctttttgttatttctggaacaaaaaaaaacaaagtaggcacttatgaaactttctcatacccttaggtgatgtaatcagccatataatttatatttgatttcccagggaaggaatcccaaacttttacgaatgtaaactcccttggagaagagggttaggacgctgttgcgctcaagcccccctcagctgtgtgcacactgagccaggacagggtctttgagctttcccactataagaagaacagcaacaaaaggccgtctagaaaaacagaacctgcctctgcttctgctcagggtgtccccgctgggtttccattgtcctttctccattgctccctcctgtggacagccatcttgctcatgtaccagccctcatcaccccatccccataaatgggtgtcctcgaggcctctgcctgggggtcagaggtcaccacagggtggccattggcatgtccccgtacatcgttagaagcttgaattcgagcagtagtagtagtagtagtaggcggccgc

SEQ ID NO: 458648 - DNA, 417 bp, Homo sapiens
cacctacattctatgccagcagcctgatcaggtcctgggtaatgtttgaaatggctacacagaggagtttcaaagccttttgttcaatctggcttcacctcgtagacggtgagaaagcgtcagagccctgcaggatcccgttgccacgtttgaccggggagccgatgggtttggaagtctgagccctgtctgcacaacctgccccggtcagcagcttcgtgcccccacccccatctccccatgaggcaggcatctgtgctgaccatggcttccatgttcagaaacccccaggcctttgagttatcatgaagcttgtgggatgtgctccaagcctcctgccatagaaaaactgccatattgctcacaataattcactattatttgtttccccagttaaaatgcgcacaatactggcca

SEQ ID NO: 458649 - DNA, 408 bp, Homo sapiens
agtgcctgcctggagcagctggtgggagagcgcagcgccagcacgtaggacacactcggttcatgggctgatgccgttcgcattgactgcctcttcagctgggtgttgagccacaccttggagtcaccagtctttggagaccaagtctgctacttttttctctaaagtgacaatcctctgaaacctccagatcatcttgaagcccccgtctgaaagttgcccagagccagtgcctcacctgctgttccttgttcactttttcacgggaggccttgcagggctttatgacaagattttatgggtggctgcccagcatcattgtgactcgtgagacagagagaaaccagttgtaaccatgtagacagtggaagtgatagggagaaaagaggtgaggggactcttcaatcc

SEQ ID NO: 458650 - DNA, 3319 bp, Homo sapiens
aggcgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttaca

SEQ ID NO: 458651 - DNA, 4768 bp, Homo sapiens
aggcgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacagggtatgtttccactgacagacgcgctggcgagatgctcgtgtgcagagagcactggccgctagcccgatggtaggattcagttctgtggtgcatctgagccagtctcagaagaaacagatcaaaggtttttaaagtctggaactgtggaagggctaacaagagaattaaggatcgatgcactggggttttaaggagccctctggtcccaagaatataagagtctaatctcagggccttaacctattcaggagtaagtagagaaaatgccaaatacgtctgtttctctctctctttttttttttattcctttgtttttggaaaaaaatagaattacaacacattgttgtttttaacctttataaaaagcagctttttgttatttctggaacaaaaaaaaacaaagtaggcacttatgaaactttctcatacccttaggtgatgtaatcagccatataatttatatttgatttcccagggaaggaatcccaaacttttacgaatgtaaactcccttggagaagagggttaggacgctgttgcgctcaagcccccctcagctgtgtgcacactgagccaggacagggtctttgagctttcccactataagaagaacagcaacaaaaggccgtctagaaaaacagaacctgcctctgcttctgctcagggtgtccccgctgggtttccattgtcctttctccattgctccctcctgtggacagccatcttgctcatgtaccagccctcatcaccccatccccataaatgggtgtcctcgaggcctctgcctgggggtcagaggtcaccacagggtggccattggcatgtcaacccgctgttaattcagagaagtgggctccacctcattgggagaagtgccatttcagcagaaattcacacgttagacgtgtgttgctgttaagtaaggggaagagagaggactagcctcagagctctggccatggaaatgacctcctaagactttttcgtggttttaaatattttacctctttccaggtggcatctgagtacatcagatggttttgcaaaatgcaaacaattttttccttggggatgatttttggggagagggggctactgtaaaaaataaaaccaaaaccccctttgctccctcggaggttgaagttgccggggggtgtggccggggtcatgcatgaggcgacagctctgcaggtgcgggtctgggctcatctgaactgtttggtttcattccagttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaaataaaaacaaaaaaagcaaggtgttttggtataataccttttcaggtgtgtgtggatacgtggctgcatgaccgggtgggtgggggggagtgtctcagggtcttctgtgacctcacagaactgtcagactgtacagttttccaacttgccatattcatgatgggtttgcattttagctgcaacaataaaatttttttctaaagaacataaattt

SEQ ID NO: 458652 - DNA, 3330 bp, Homo sapiens
gttgactcagaggatcccagttcgacggagactctgatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccaacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctcctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcaacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctgggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatatgccttaagccaatatttactcatcaggtcattattttttacaatggccatggaataaaccatttttacaaaaataaaaacaaaaaaagcaaggtgttttggtataataccttttcaggtgtgtgtggatacgtggctgcatgaccgggtgggtgggggggagtgtctcagggtcttctgtgacctcacagaactgtcagactgtacagttttccaacttgccatattcatgatgggtttgcattttagctgcaacaataaaatttttttctaaagaacataaattt

SEQ ID NO: 458653 - DNA, 986 bp, Homo sapiens
ctcagaaaattaactgattcagagcgtgccttcctcccctctcgctccacaacaccacatagctctgcagcggtctcttcctaagtgtttggtggaacttgctggtgaagccatctagattgggcccagcggaagggctgagctgccaggatgaccccaaagggatgggatgttacagttgggtccttgggtccttgaaggcctttgctgccccagggctggatggggcagaaccagattgttggggcagggaaaagaggaaaaaaatggctgctggggtggaggaaccggcatgtccagcccctgctgcttttctcaggggtcacagaggaggtggttgggtgcaggacaggccagggcctgggcgttgctggcattgaccatccctgtgtgattgacagctgtagctggaaccactataacatgcagtacgcactagcagtttccaagcagcggggcacaaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccagggagatgggacccttgtgccacctgggccagcaaagaggaggggtccagagaacagctgaaatactgtcactagtggtagtgacttgcttttcctgtgcacacatgtagcccatcaggacagcgagccgacgggtcacgccaggggccggcacgcactggcacctggccccaggagcggggccgtgtgaacggtgatgaatgttgaaaatgcgtctcagagaggtattcacatgaactttgtatgagacttatttatatttttaacataaaggtttgataaagaacttagggattaaaaaaaagatggagttttctaacgtgaggatgaagtctacacttcagattaaaaagggttatgttgta

SEQ ID NO: 458654 - DNA, 2462 bp, Homo sapiens
  misc_feature (1)..(1): n is a, c, g, or t
nccacccctacggctaggtagcgaggccgggtgttgaacgagggcgacagagagaccaccatccggggaaaagccactccggccgaggaggagaagacaggaaaagtgaagtactcacggctggccaagtacttcttcaataaagaaggggattttaacaacctgacagctgcagcatttcataagaagtctcacctcttggtcactggctttgcttctggaatcttccatcttcatgagctgccagagtttaacctcatccactccctgagcatctcagatcagagcatcgcctcagtggccatcaatagctcgggggactggattgcttttggctgttcaggcctgggccagctgctggtgtgggagtggcagagtgagtcctacgtgctcaagcagcagggccacttcaacagcatggtggccctggcctactcgcccgacggacagtacatcgtgactggcggggacgacggcaaggtcaaggtgtggaacaccctcagcggcttctgcttcgtcacttttacggagcactccagcggggtgaccggtgtgacctttactgccaccggctacgttgtggtgacctcatccatggacgggaccgtgcgagcctttgaccttcacaggtaccgaaacttccgcaccttcacctctccacgccccacccagttctcctgtgtggcggtggatgcgagcggtgagatcgtctctgcaggggcgcaggactcctttgagattttcgtgtggtccatgcagacaggcaggctccttgatgttttgtctggacacgaagggcccatcagtggtctgtgttttaacccaatgaagtccgtcctggccagtgcctcctgggacaagacggtgcgcctatgggacatgtttgacagctggaggaccaaggagacgctggccctgacctctgatgctctggctgtgacttttcgccctgatggtgcggagctggctgtggccacactgaactcacagatcaccttctgggaccctgagaacgcggtgcagacgggctccattgagggcaggcatgacctcaagactggcaggaaggagctggacaagattacagccaagcacgcggccaaggggaaggccttcaccgccctgtgctactctgcagacggccacagcatcctggcgggaggcatgtccaagttcgtgtgcatctaccacgtccgtgagcagattctcatgaagaggttcgagatctcttgcaacctgtctctggacgccatggaggaatttttgaaccgaagaaaaatgacagagtttggcaacctggcactaattgatcaggatgctgggcaggaggatggagtcgcgataccactgccaggcgtcaggaaaggtgacatgagttctcggcacttcaaacctgagatcagggtgacctcactccgcttctctcccactgggcgctgctgggcggccaccaccacggagggactcctcatctactccctggacacccgcgtgctctttgacccgtttgagctggacaccagcgtcacccccgggagggtgcgcgaggcactgcgccagcaggacttcaccagggccatcctcatggccctccggctcaacgagagcaaactggtgcaggaggccctggaggcggtgcccaggggcgagattgaagtggtcacctcctcccttcctgaactgtatgtggagaaagtgctggagtttttagcttcctcctttgaagtgtctcgccacctggaattctacctcctctggactcacaaactgctcatgttgcacggacagaagctgaagtccagagccgggacgctgctgcctgtcattcagttcctccagaagagcatccagcggcacctggacgacctgtcgaaactctgtagctggaaccactataacatgcagtacgcactagcagtttccaagcagcggggcacaaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccagggagatgggacccttgtgccacctgggccagcaaagaggaggggtccagagaacagctgaaatactgtcactagtggtagtgacttgcttttcctgtgcacacatgtagcccatcaggacagcgagccgacgggtcacgccaggggccggcacgcactggcacctggccccaggagcggggccgtgtgaacggtgatgaatgttgaaaatgcgtctcagagaggtattcacatgaactttgtatgagacttatttatatttttaacataaaggtttgataaagaacttagggattaaaaaaaagatggagttttctaacgtgaggatgaagtctacacttcagattaaaaagggttatgttgta

SEQ ID NO: 458655 - DNA, 3043 bp, Homo sapiens
tgcgtgctgtgggcggtgccgcgcggacccccgggaagtgtctctgtgggcggccgccgggttgagctgcggcacacgtgcgacggccgtgatgaagttcgcttaccggttttcaaatttgctgggtacggtgtaccggcgtgggaacctaaattttacctgcaatggaaattcagttatcagtcccgtgggcaatagagtcactgtatttgaccttaaaaacaacaaatctgacacgctgcccctggccactcggtacaacgtcaagtgcgtggggctgtccccggatggccgcctcgctatcatcgtcgatgaagggggcgatgcgctgctggtcagcctggtctgcaggtctgtgctgcaccacttccacttcaagggctctgtgcacagtgtgtccttctcccctgatggcaggaagtttgttgtcacaaagggtaacattgcccagatgtatcatgcccctgggaagaagcgggagttcaacgccttcgttctggacaagacctattttgggccctacgatgagaccacctgcatcgactggacggatgactccaggtgctttgtggttgggagcaaagacatgtccacctgggtgttcggagccgagcgctgggacaacctcatctactatgcactggggggacataaggatgccatcgtggcctgcttctttgaatccaacagcctggacctgtactcactcagccaggacggagtgctgtgcatgtggcagtgtgacacgccccccgagggcttgcggctgaagccccctgcgggctggaaagcagacctgttgcagcgggaggaggaagaggaggaggaggaggaccaggagggcgacagagagaccaccatccggggaaaagccactccggccgaggaggagaagacaggaaaagtgaagtactcacggctggccaagtacttcttcaataaagaaggggattttaacaacctgacagctgcagcatttcataagaagtctcacctcttggtcactggctttgcttctggaatcttccatcttcatgagctgccagagtttaacctcatccactccctgagcatctcagatcagagcatcgcctcagtggccatcaatagctcgggggactggattgcttttggctgttcaggcctgggccagctgctggtgtgggagtggcagagtgagtcctacgtgctcaagcagcagggccacttcaacagcatggtggccctggcctactcgcccgacggacagtacatcgtgactggcggggacgacggcaaggtcaaggtgtggaacaccctcagcggcttctgcttcgtcacttttacggagcactccagcggggtgaccggtgtgacctttactgccaccggctacgttgtggtgacctcatccatggacgggaccgtgcgagcctttgaccttcacaggtaccgaaacttccgcaccttcacctctccacgccccacccagttctcctgtgtggcggtggatgcgagcggtgagatcgtctctgcaggggcgcaggactcctttgagattttcgtgtggtccatgcagacaggcaggctccttgatcttctgggaccctgagaacgcggtgcagacgggctccattgagggcaggcatgacctcaagactggcaggaaggagctggacaagattacagccaagcacgcggccaaggggaaggccttcaccgccctgtgctactctgcagacggccacagcatcctggcgggaggcatgtccaagttcgtgtgcatctaccacgtccgtgagcagattctcatgaagaggttcgagatctcttgcaacctgtctctggacgccatggaggaatttttgaaccgaagaaaaatgacagagtttggcaacctggcactaattgatcaggatgctgggcaggaggatggagtcgcgataccactgccaggcgtcaggaaaggtgacatgagttctcggcacttcaaacctgagatcagggtgacctcactccgcttctctcccactgggcgctgctgggcggccaccaccacggagggactcctcatctactccctggacacccgcgtgctctttgacccgtttgagctggacaccagcgtcacccccgggagggtgcgcgaggcactgcgccagcaggacttcaccagggccatcctcatggccctccggctcaacgagagcaaactggtgcaggaggccctggaggcggtgcccaggggcgagattgaagtggtcacctcctcccttcctgaactgtatgtggagaaagtgctggagtttttagcttcctcctttgaagtgtctcgccacctggaattctacctcctctggactcacaaactgctcatgttgcacggacagaagctgaagtccagagccgggacgctgctgcctgtcattcagttcctccagaagagcatccagcggcacctggacgacctgtcgaaactctgtagctggaaccactataacatgcagtacgcactagcagtttccaagcagcggggcacaaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccagggagatgggacccttgtgccacctgggccagcaaagaggaggggtccagagaacagctgaaatactgtcactagtggtagtgacttgcttttcctgtgcacacatgtagcccatcaggacagcgagccgacgggtcacgccaggggccggcacgcactggcacctggccccaggagcggggccgtgtgaacggtgatgaatgttgaaaatgcgtctcagagaggtattcacatgaactttgtatgagacttatttatatttttaacataaaggtttgataaagaacttagggattaaaaaaaagatggagttttctaacgtgaggatgaagtctacacttcagattaaaaagggttatgttgta

SEQ ID NO: 458656 - DNA, 2290 bp, Homo sapiens
  misc_feature (32)..(32): n is a, c, g, or t
caaatgtaaggctaggtacgaggctgggtgtnactggctttgcttctggaatcttccatcttcatgagctgccagagtttaacctcatccactccctgagcatctcagatcagagcatcgcctcagtggccatcaatagctcgggggactggattgcttttggctgttcaggcctgggccagctgctggtgtgggagtggcagagtgagtcctacgtgctcaagcagcagggccacttcaacagcatggtggccctggcctactcgcccgacggacagtacatcgtgactggcggggacgacggcaaggtcaaggtgtggaacaccctcagcggcttctgcttcgtcacttttacggagcactccagcggggtgaccggtgtgacctttactgccaccggctacgttgtggtgacctcatccatggacgggaccgtgcgagcctttgaccttcacaggtaccgaaacttccgcaccttcacctctccacgccccacccagttctcctgtgtggcggtggatgcgagcggtgagatcgtctctgcaggggcgcaggactcctttgagattttcgtgtggtccatgcagacaggcaggctccttgatgttttgtctggacacgaagggcccatcagtggtctgtgttttaacccaatgaagtccgtcctggccagtgcctcctgggacaagacggtgcgcctatgggacatgtttgacagctggaggaccaaggagacgctggccctgacctctgatgctctggctgtgacttttcgccctgatggtgcggagctggctgtggccacactgaactcacagatcaccttctgggaccctgagaacgcggtgcagacgggctccattgagggcaggcatgacctcaagactggcaggaaggagctggacaagattacagccaagcacgcggccaaggggaaggccttcaccgccctgtgctactctgcagacggccacagcatcctggcgggaggcatgtccaagttcgtgtgcatctaccacgtccgtgagcagattctcatgaagaggttcgagatctcttgcaacctgtctctggacgccatggaggaatttttgaaccgaagaaaaatgacagagtttggcaacctggcactaattgatcaggatgctgggcaggaggatggagtcgcgataccactgccaggcgtcaggaaaggtgacatgagttctcggcacttcaaacctgagatcagggtgacctcactccgcttctctcccactgggcgctgctgggcggccaccaccacggagggactcctcatctactccctggacacccgcgtgctctttgacccgtttgagctggacaccagcgtcacccccgggagggtgcgcgaggcactgcgccagcaggacttcaccagggccatcctcatggccctccggctcaacgagagcaaactggtgcaggaggccctggaggcggtgcccaggggcgagattgaagtggtcacctcctcccttcctgaactgtatgtggagaaagtgctggagtttttagcttcctcctttgaagtgtctcgccacctggaattctacctcctctggactcacaaactgctcatgttgcacggacagaagctgaagtccagagccgggacgctgctgcctgtcattcagttcctccagaagagcatccagcggcacctggacgacctgtcgaaactctgtagctggaaccactataacatgcagtacgcactagcagtttccaagcagcggggcacaaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccagggagatgggacccttgtgccacctgggccagcaaagaggaggggtccagagaacagctgaaatactgtcactagtggtagtgacttgcttttcctgtgcacacatgtagcccatcaggacagcgagccgacgggtcacgccaggggccggcacgcactggcacctggccccaggagcggggccgtgtgaacggtgatgaatgttgaaaatgcgtctcagagaggtattcacatgaactttgtatgagacttatttatatttttaacataaaggtttgataaagaacttagggattaaaaaaaagatggagttttctaacgtgaggatgaagtctacacttcagattaaaaagggttatgttgta

SEQ ID NO: 458657 - DNA, 2336 bp, Homo sapiens
tgcgtgctgtgggcggtgccgcgcggacccccgggaagtgtctctgtgggcggccgccgggttgagctgcggcacacgtgcgacggccgtgatgaagttcgcttaccggttttcaaatttgctgggtacggtgtaccggcgtgggaacctaaattttacctgcaatggaaattcagttatcagtcccgtgggcaatagagtcactgtatttgaccttaaaaacaacaaatctgacacgctgcccctggccactcggtacaacgtcaagtgcgtggggctgtccccggatggccgcctcgctatcatcgtcgatgaagggggcgatgcgctgctggtcagcctggtctgcaggtctgtgctgcaccacttccacttcaagggctctgtgcacagtgtgtccttctcccctgatggcaggaagtttgttgtcacaaagggtaacattgcccagatgtatcatgcccctgggaagaagcgggagttcaacgccttcgttctggacaagacctattttgggccctacgatgagaccacctgcatcgactggacggatgactccaggtgctttgtggttgggagcaaagacatgtccacctgggtgttcggagccgagcgctgggacaacctcatctactatgcactggggggacataaggatgccatcgtggcctgcttctttgaatccaacagcctggacctgtactcactcagccaggacggagtgctgtgcatgtggcagtgtgacacgccccccgagggcttgcggctgaagccccctgcgggctggaaagcagacctgttgcagcgggaggaggaagaggaggaggaggaggaccaggagggcgacagagagaccaccatccggggaaaagccactccggccgaggaggagaagacaggaaaagtgaagtactcacggctggccaagtacttcttcaataaagaaggggattttaacaacctgacagctgcagcatttcataagaagtctcacctcttggtcactggctttgcttctggaatcttccatcttcatgagctgccagagtttaacctcatccactccctgagcatctcagatcagagcatcgcctcagtggccatcaatagctcgggggactggattgcttttggctgttcaggcctgggccagctgctggtgtgggagtggcagagtgagtcctacgtgctcaagcagcagggccacttcaacagcatggtggccctggcctactcgcccgacggacagtacatcgtgactggcggggacgacggcaaggtcaaggtgtggaacaccctcagcggcttctgcttcgtcacttttacggagcactccagcggggtgaccggtgtgacctttactgccaccggctacgttgtggtgacctcatccatggacgggaccgtgcgagcctttgaccttcacaggtaccgaaacttccgcaccttcacctctccacgccccacccagttctcctgtgtggcggtggatgcgagcggtgagatcgtctctgcaggggcgcaggactcctttgagattttcgtgtggtccatgcagacaggcaggctccttgatgttttgtctggacacgaagggcccatcagtggtctgtgttttaacccaatgaagtccgtcctggccagtgcctcctgggacaagacggtgcgcctatgggacatgtttgacagctggaggaccaaggagacgctggccctgacctctgatgctctggctgtgacttttcgccctgatggtgcggagctggctgtggccacactgaactcacagatcaccttctgggaccctgagaacgcggtgcagacgggctccattgagggcaggcatgacctcaagactggcaggaaggagctggacaagattacagccaagcacgcggccaaggggaaggccttcaccgccctgtgctactctgcagacggccacagcatcctggcgggaggcatgtccaagttcgtgtgcatctaccacgtccgtgagcagattctcatgaagaggttcgagaacagctgaaatactgtcactagtggtagtgacttgcttttcctgtgcacacatgtagcccatcaggacagcgagccgacgggtcacgccaggggccggcacgcactggcacctggccccaggagcggggccgtgtgaacggtgatgaatgttgaaaatgcgtctcagagaggtattcacatgaactttgtatgagacttatttatatttttaacataaaggtttgataaagaacttagggattaaaaaaaagatggagttttctaacgtgaggatgaagtctacacttcagattaaaaagggttatgttgta

SEQ ID NO: 458658 - DNA, 362 bp, Homo sapiens
cacctgctttggtcactgatgttttactgggacattttactgggcgtttttttgttggcggatccttctggctgtctctagtgatccgtgcagcactgagtaggtgcagcagagaccacagggcctgcggagctgaagacgcctgagctagacagaagacttggctggctcccggcgtcaagagaggacgacgcatgcgtgtacatatttgcttatatgtgcatccctgggagagtaacttctgggatgatccattcattccttcccaggggagtagtggggtgggggctagaggcagacgtcccggttcctcctgatttttgcactttgtcccaggggaatgtacttaatactgtttcttt

SEQ ID NO: 458659 - DNA, 464 bp, Homo sapiens
tatgagacttatttatatttttaacataaaggtttgataaagaacttagggattaaaaaaaagatggagttttctaacgtgaggatgaagtctacacttcagattaaaaagggttatgttgtatcctgctgtcttgtgggggctcaagacctgcctgccttaccaccagggcctccgtcctggggaagcaggctgacagagcagggtgctcctgctgtctagcgggggctctgccttgtgacctgtgcatatccttggggtcaggggcacagagcctctccctgacctcttggggatgctttggagtctggggctgggattggcctgtcttggtgagctcactcagacctgcaccagctctgcgtgggccacacggaggaggagacagctcctcccctctgcagtgcccttgggaatagtcatcatgagagaggcttgggtctccatcatggtagggcatcctg

SEQ ID NO: 458660 - DNA, 3261 bp, Homo sapiens
tgcgtgctgtgggcggtgccgcgcggacccccgggaagtgtctctgtgggcggccgccgggttgagctgcggcacacgtgcgacggccgtgatgaagttcgcttaccggttttcaaatttgctgggtacggtgtaccggcgtgggaacctaaattttacctgcaatggaaattcagttatcagtcccgtgggcaatagagtcactgtatttgaccttaaaaacaacaaatctgacacgctgcccctggccactcggtacaacgtcaagtgcgtggggctgtccccggatggccgcctcgctatcatcgtcgatgaagggggcgatgcgctgctggtcagcctggtctgcaggtctgtgctgcaccacttccacttcaagggctctgtgcacagtgtgtccttctcccctgatggcaggaagtttgttgtcacaaagggtaacattgcccagatgtatcatgcccctgggaagaagcgggagttcaacgccttcgttctggacaagacctattttgggccctacgatgagaccacctgcatcgactggacggatgactccaggtgctttgtggttgggagcaaagacatgtccacctgggtgttcggagccgagcgctgggacaacctcatctactatgcactggggggacataaggatgccatcgtggcctgcttctttgaatccaacagcctggacctgtactcactcagccaggacggagtgctgtgcatgtggcagtgtgacacgccccccgagggcttgcggctgaagccccctgcgggctggaaagcagacctgttgcagcgggaggaggaagaggaggaggaggaggaccaggagggcgacagagagaccaccatccggggaaaagccactccggccgaggaggagaagacaggaaaagtgaagtactcacggctggccaagtacttcttcaataaagaaggggattttaacaacctgacagctgcagcatttcataagaagtctcacctcttggtcactggctttgcttctggaatcttccatcttcatgagctgccagagtttaacctcatccactccctgagcatctcagatcagagcatcgcctcagtggccatcaatagctcgggggactggattgcttttggctgttcaggcctgggccagctgctggtgtgggagtggcagagtgagtcctacgtgctcaagcagcagggccacttcaacagcatggtggccctggcctactcgcccgacggacagtacatcgtgactggcggggacgacggcaaggtcaaggtgtggaacaccctcagcggcttctgcttcgtcacttttacggagcactccagcggggtgaccggtgtgacctttactgccaccggctacgttgtggtgacctcatccatggacgggaccgtgcgagcctttgaccttcacaggtaccgaaacttccgcaccttcacctctccacgccccacccagttctcctgtgtggcggtggatgcgagcggtgagatcgtctctgcaggggcgcaggactcctttgagattttcgtgtggtccatgcagacaggcaggctccttgatgttttgtctggacacgaagggcccatcagtggtctgtgttttaacccaatgaagtccgtcctggccagtgcctcctgggacaagacggtgcgcctatgggacatgtttgacagctggaggaccaaggagacgctggccctgacctctgatgctctggctgtgacttttcgccctgatggtgcggagctggctgtggccacactgaactcacagatcaccttctgggaccctgagaacgcggtgcagacgggctccattgagggcaggcatgacctcaagactggcaggaaggagctggacaagattacagccaagcacgcggccaaggggaaggccttcaccgccctgtgctactctgcagacggccacagcatcctggcgggaggcatgtccaagttcgtgtgcatctaccacgtccgtgagcagattctcatgaagaggttcgagatctcttgcaacctgtctctggacgccatggaggaatttttgaaccgaagaaaaatgacagagtttggcaacctggcactaattgatcaggatgctgggcaggaggatggagtcgcgataccactgccaggcgtcaggaaaggtgacatgagttctcggcacttcaaacctgagatcagggtgacctcactccgcttctctcccactgggcgctgctgggcggccaccaccacggagggactcctcatctactccctggacacccgcgtgctctttgacccgtttgagctggacaccagcgtcacccccgggagggtgcgcgaggcactgcgccagcaggacttcaccagggccatcctcatggccctccggctcaacgagagcaaactggtgcaggaggccctggaggcggtgcccaggggcgagattgaagtggtcacctcctcccttcctgaactgtatgtggagaaagtgctggagtttttagcttcctcctttgaagtgtctcgccacctggaattctacctcctctggactcacaaactgctcatgttgcacggacagaagctgaagtccagagccgggacgctgctgcctgtcattcagttcctccagaagagcatccagcggcacctggacgacctgtcgaaactctgtagctggaaccactataacatgcagtacgcactagcagtttccaagcagcggggcacaaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccagggagatgggacccttgtgccacctgggccagcaaagaggaggggtccagagaacagctgaaatactgtcactagtggtagtgacttgcttttcctgtgcacacatgtagcccatcaggacagcgagccgacgggtcacgccaggggccggcacgcactggcacctggccccaggagcggggccgtgtgaacggtgatgaatgttgaaaatgcgtctcagagaggtattcacatgaactttgtatgagacttatttatatttttaacataaaggtttgataaagaacttagggattaaaaaaaagatggagttttctaacgtgaggatgaagtctacacttcagattaaaaagggttatgttgta

SEQ ID NO: 458661 - DNA, 3380 bp, Homo sapiens
tgcgtgctgtgggcggtgccgcgcggacccccgggaagtgtctctgtgggcggccgccgggttgagctgcggcacacgtgcgacggccgtgatgaagttcgcttaccggttttcaaatttgctgggtacggtgtaccggcgtgggaacctaaattttacctgcaatggaaattcagttatcagtcccgtgggcaatagagtcactgtatttgaccttaaaaacaacaaatctgacacgctgcccctggccactcggtacaacgtcaagtgcgtggggctgtccccggatggccgcctcgctatcatcgtcgatgaagggggcgatgcgctgctggtcagcctggtctgcaggtctgtgctgcaccacttccacttcaagggctctgtgcacagtgtgtccttctcccctgatggcaggaagtttgttgtcacaaagggtaacattgcccagatgtatcatgcccctgggaagaagcgggagttcaacgccttcgttctggacaagacctattttgggccctacgatgagaccacctgcatcgactggacggatgactccaggtgctttgtggttgggagcaaagacatgtccacctgggtgttcggagccgagcgctgggacaacctcatctactatgcactggggggacataaggatgccatcgtggcctgcttctttgaatccaacagcctggacctgtactcactcagccaggacggagtgctgtgcatgtggcagtgtgacacgccccccgagggcttgcggctgaagccccctgcgggctggaaagcagacctgttgcagcgggaggaggaagaggaggaggaggaggaccaggagggcgacagagagaccaccatccggggaaaagccactccggccgaggaggagaagacaggaaaagtgaagtactcacggctggccaagtacttcttcaataaagaaggggattttaacaacctgacagctgcagcatttcataagaagtctcacctcttggtcactggctttgcttctggaatcttccatcttcatgagctgccagagtttaacctcatccactccctgagcatctcagatcagagcatcgcctcagtggccatcaatagctcgggggactggattgcttttggctgttcaggcctgggccagctgctggtgtgggagtggcagagtgagtcctacgtgctcaagcagcagggccacttcaacagcatggtggccctggcctactcgcccgacggacagtacatcgtgactggcggggacgacggcaaggtcaaggtgtggaacaccctcagcggcttctgcttcgtcacttttacggagcactccagcggggtgaccggtgtgacctttactgccaccggctacgttgtggtgacctcatccatggacgggaccgtgcgagcctttgaccttcacaggtaccgaaacttccgcaccttcacctctccacgccccacccagttctcctgtgtggcggtggatgcgagcggtgagatcgtctctgcaggggcgcaggactcctttgagattttcgtgtggtccatgcagacaggcaggctccttgatgttttgtctggacacgaagggcccatcagtggtctgtgttttaacccaatgaagtccgtcctggccagtgcctcctgggacaagacggtgcgcctatgggacatgtttgacagctggaggaccaaggagacgctggccctgacctctgatgctctggctgtgacttttcgccctgatggtgcggagctggctgtggccacactgaactcacagatcaccttctgggaccctgagaacgcggtgcagacgggctccattgagggcaggcatgacctcaagactggcaggaaggagctggacaagattacagccaagcacgcggccaaggggaaggccttcaccgccctgtgctactctgcagacggccacagcatcctggcgggaggcatgtccaagttcgtgtgcatctaccacgtccgtgagcagattctcatgaagaggttcgagatctcttgcaacctgtctctggacgccatggaggaatttttgaaccgaagaaaaatgacagagtttggcaacctggcactaattgatcaggatgctgggcaggaggatggagtcgcgataccactgccaggcgtcaggaaaggtgacatgagttctcggcacttcaaacctgagatcagggtgacctcactccgcttctctcccactgtgatccgtgcagcactgagtaggtgcagcagagaccacagggcctgcggagctgaagacgcctgagctagacagaagacttggctggctcccggcgtcaagagaggacgacgcatgcgtggcgctgctgggcggccaccaccacggagggactcctcatctactccctggacacccgcgtgctctttgacccgtttgagctggacaccagcgtcacccccgggagggtgcgcgaggcactgcgccagcaggacttcaccagggccatcctcatggccctccggctcaacgagagcaaactggtgcaggaggccctggaggcggtgcccaggggcgagattgaagtggtcacctcctcccttcctgaactgtatgtggagaaagtgctggagtttttagcttcctcctttgaagtgtctcgccacctggaattctacctcctctggactcacaaactgctcatgttgcacggacagaagctgaagtccagagccgggacgctgctgcctgtcattcagttcctccagaagagcatccagcggcacctggacgacctgtcgaaactctgtagctggaaccactataacatgcagtacgcactagcagtttccaagcagcggggcacaaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccagggagatgggacccttgtgccacctgggccagcaaagaggaggggtccagagaacagctgaaatactgtcactagtggtagtgacttgcttttcctgtgcacacatgtagcccatcaggacagcgagccgacgggtcacgccaggggccggcacgcactggcacctggccccaggagcggggccgtgtgaacggtgatgaatgttgaaaatgcgtctcagagaggtattcacatgaactttgtatgagacttatttatatttttaacataaaggtttgataaagaacttagggattaaaaaaaagatggagttttctaacgtgaggatgaagtctacacttcagattaaaaagggttatgttgta

SEQ ID NO: 458662 - DNA, 2740 bp, Homo sapiens
tgcgtgctgtgggcggtgccgcgcggacccccgggaagtgtctctgtgggcggccgccgggttgagctgcggcacacgtgcgacggccgtgatgaagttcgcttaccggttttcaaatttgctgggtacggtgtaccggcgtgggaacctaaattttacctgcaatggaaattcagttatcagtcccgtgggcaatagagtcactgtatttgaccttaaaaacaacaaatctgacacgctgcccctggccactcggtacaacgtcaagtgcgtggggctgtccccggatggccgcctcgctatcatcgtcgatgaaggagggcgacagagagaccaccatccggggaaaagccactccggccgaggaggagaagacaggaaaagtgaagtactcacggctggccaagtacttcttcaataaagaaggggattttaacaacctgacagctgcagcatttcataagaagtctcacctcttggtcactggctttgcttctggaatcttccatcttcatgagctgccagagtttaacctcatccactccctgagcatctcagatcagagcatcgcctcagtggccatcaatagctcgggggactggattgcttttggctgttcaggcctgggccagctgctggtgtgggagtggcagagtgagtcctacgtgctcaagcagcagggccacttcaacagcatggtggccctggcctactcgcccgacggacagtacatcgtgactggcggggacgacggcaaggtcaaggtgtggaacaccctcagcggcttctgcttcgtcacttttacggagcactccagcggggtgaccggtgtgacctttactgccaccggctacgttgtggtgacctcatccatggacgggaccgtgcgagcctttgaccttcacaggtaccgaaacttccgcaccttcacctctccacgccccacccagttctcctgtgtggcggtggatgcgagcggtgagatcgtctctgcaggggcgcaggactcctttgagattttcgtgtggtccatgcagacaggcaggctccttgatgttttgtctggacacgaagggcccatcagtggtctgtgttttaacccaatgaagtccgtcctggccagtgcctcctgggacaagacggtgcgcctatgggacatgtttgacagctggaggaccaaggagacgctggccctgacctctgatgctctggctgtgacttttcgccctgatggtgcggagctggctgtggccacactgaactcacagatcaccttctgggaccctgagaacgcggtgcagacgggctccattgagggcaggcatgacctcaagactggcaggaaggagctggacaagattacagccaagcacgcggccaaggggaaggccttcaccgccctgtgctactctgcagacggccacagcatcctggcgggaggcatgtccaagttcgtgtgcatctaccacgtccgtgagcagattctcatgaagaggttcgagatctcttgcaacctgtctctggacgccatggaggaatttttgaaccgaagaaaaatgacagagtttggcaacctggcactaattgatcaggatgctgggcaggaggatggagtcgcgataccactgccaggcgtcaggaaaggtgacatgagttctcggcacttcaaacctgagatcagggtgacctcactccgcttctctcccactgggcgctgctgggcggccaccaccacggagggactcctcatctactccctggacacccgcgtgctctttgacccgtttgagctggacaccagcgtcacccccgggagggtgcgcgaggcactgcgccagcaggacttcaccagggccatcctcatggccctccggctcaacgagagcaaactggtgcaggaggccctggaggcggtgcccaggggcgagattgaagtggtcacctcctcccttcctgaactgtatgtggagaaagtgctggagtttttagcttcctcctttgaagtgtctcgccacctggaattctacctcctctggactcacaaactgctcatgttgcacggacagaagctgaagtccagagccgggacgctgctgcctgtcattcagttcctccagaagagcatccagcggcacctggacgacctgtcgaaactctgtagctggaaccactataacatgcagtacgcactagcagtttccaagcagcggggcacaaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccagggagatgggacccttgtgccacctgggccagcaaagaggaggggtccagagaacagctgaaatactgtcactagtggtagtgacttgcttttcctgtgcacacatgtagcccatcaggacagcgagccgacgggtcacgccaggggccggcacgcactggcacctggccccaggagcggggccgtgtgaacggtgatgaatgttgaaaatgcgtctcagagaggtattcacatgaactttgtatgagacttatttatatttttaacataaaggtttgataaagaacttagggattaaaaaaaagatggagttttctaacgtgaggatgaagtctacacttcagattaaaaagggttatgttgta

SEQ ID NO: 458663 - DNA, 2072 bp, Homo sapiens
  misc_feature (32)..(32): n is a, c, g, or t
caaatgtaaggctaggtacgaggctgggtgtnactggctttgcttctggaatcttccatcttcatgagctgccagagtttaacctcatccactccctgagcatctcagatcagagcatcgcctcagtggccatcaatagctcgggggactggattgcttttggctgttcaggcctgggccagctgctggtgtgggagtggcagagtgagtcctacgtgctcaagcagcagggccacttcaacagcatggtggccctggcctactcgcccgacggacagtacatcgtgactggcggggacgacggcaaggtcaaggtgtggaacaccctcagcggcttctgcttcgtcacttttacggagcactccagcggggtgaccggtgtgacctttactgccaccggctacgttgtggtgacctcatccatggacgggaccgtgcgagcctttgaccttcacaggtaccgaaacttccgcaccttcacctctccacgccccacccagttctcctgtgtggcggtggatgcgagcggtgagatcgtctctgcaggggcgcaggactcctttgagattttcgtgtggtccatgcagacaggcaggctccttgatcttctgggaccctgagaacgcggtgcagacgggctccattgagggcaggcatgacctcaagactggcaggaaggagctggacaagattacagccaagcacgcggccaaggggaaggccttcaccgccctgtgctactctgcagacggccacagcatcctggcgggaggcatgtccaagttcgtgtgcatctaccacgtccgtgagcagattctcatgaagaggttcgagatctcttgcaacctgtctctggacgccatggaggaatttttgaaccgaagaaaaatgacagagtttggcaacctggcactaattgatcaggatgctgggcaggaggatggagtcgcgataccactgccaggcgtcaggaaaggtgacatgagttctcggcacttcaaacctgagatcagggtgacctcactccgcttctctcccactgggcgctgctgggcggccaccaccacggagggactcctcatctactccctggacacccgcgtgctctttgacccgtttgagctggacaccagcgtcacccccgggagggtgcgcgaggcactgcgccagcaggacttcaccagggccatcctcatggccctccggctcaacgagagcaaactggtgcaggaggccctggaggcggtgcccaggggcgagattgaagtggtcacctcctcccttcctgaactgtatgtggagaaagtgctggagtttttagcttcctcctttgaagtgtctcgccacctggaattctacctcctctggactcacaaactgctcatgttgcacggacagaagctgaagtccagagccgggacgctgctgcctgtcattcagttcctccagaagagcatccagcggcacctggacgacctgtcgaaactctgtagctggaaccactataacatgcagtacgcactagcagtttccaagcagcggggcacaaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccagggagatgggacccttgtgccacctgggccagcaaagaggaggggtccagagaacagctgaaatactgtcactagtggtagtgacttgcttttcctgtgcacacatgtagcccatcaggacagcgagccgacgggtcacgccaggggccggcacgcactggcacctggccccaggagcggggccgtgtgaacggtgatgaatgttgaaaatgcgtctcagagaggtattcacatgaactttgtatgagacttatttatatttttaacataaaggtttgataaagaacttagggattaaaaaaaagatggagttttctaacgtgaggatgaagtctacacttcagattaaaaagggttatgttgta

SEQ ID NO: 458664 - DNA, 4303 bp, Homo sapiens
cagtgctgcgcgggaaggcaccaccaccacagccgccgccgctggccaggctgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagcttcctctccagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgaggtggcctggtttgctttcgaccctggctcggcgcactcggacatcatcctctccaatgacaacctgacagtgacctgtagtagctatgatgaccgggtggtgctagggaagactggcttctccaagggcatccactactgggagctcacggtagatcgctatgacaaccaccctgatcctgcctttggtgtggctcgcatggacgtgatgaaggatgtgatgttaggaaaagacgacaaagcttgggcaatgtatgtggacaataaccggagctggttcatgcacaacaactcgcacaccaacagaactgagggagggatcacaaaaggggccacaattggggtcctcctcgacttcaatagaaaaaacttgacattttttatcaacgatgaacaacaaggtcccatagcatttgataacgtggagggcctcttcttccctgcggtcagcctgaacaggaacgtgcaggtcacgctgcacaccgggctcccagtccccgacttctactccagcagagcatcaatagcctaaggatgtgccgtggaggcgccagctgcctgttcttacctccgcctgcgagagccacagcaaggagctcagccagccgtggtggggtgcagagttggcaggagtgggagaaggaggagagaaaagctggtcctctgcagtctttacacccacagctctgcccttttccctttcaacctctcctccgctgtcatgcctgcttccgcttccatgtccaacaattctaaccaacaaaggacctagacagcccaccaagtcacttggttcccactcccagattttgcttttatttaacttaattttttatgtaggtgagttatattttctttcttttctgatcaggttattggtgacttactggactggcaccgccaggagaaaattctcctgctaactttttttcttaagctttctgtcaaacaatgaggttgtagggggaggtagggaagaatgagctgaatttgtagcatacagcttacctgctagaatgttcttaccctcttacctctcctgtagcgttagctctgcagagctaagctttgggagaatgaatctatcactgagaagttttactactcattgaagcacaaaaatatccgctacacaggttcacatcagggtaggatcgttaggatggctctataattaggacaggccagaaccctggccactgtataaaattggaaagtctctaagacacaggcaaaccaggggacttaatgatttggttcgtttatttaataaaagcttttaattgagaacctactattgaccaggcactgttcaagacactagaacattatgttctagacactgtggggacacagtggtgaacagacaggcatggtctctgcccttcggagcttatattccagtaggagaaaaagcaaaaataaaataattataaatggtcatatgtactagaaaggaaatgggcaagggtcaaagagactcatgggcaagatctttcaggcttcctagaatgatgctaaaaatccacacattctggccatagcaccagaaatgtaccaactcaatgccttttcagctgcactatttaattatggtacctgctgccactcatcacagagcccttcttggtagaaatgatgtcagcattcttatttgctgatgctgctatgataccacgccttaaaaattgacagttgaaaaaaaaaagagtgaccagagggcaaaggacccattctcagtaatgggagatcttgagttgcagtccacagcattcacattctcaggataaacatgcttgtctccatatatactatctgtgcctgttatgaatgaaaaatccatccactctgctgccattcacagcctaattttctggagtagtccaaacaatgtttggaaaaacatgggactgtatgtcattactatgactgatagcagaataataatgcatcttacttctatatagagatagacttacataggttacccttgaaattcattagtttgtcataaagttttaggaaaggtaggacccggaaagaagttctaattagttgtctaaatatttttcagtgagccaagaaattcaccatgaaaaaacaagaataacaaatagaagggaagagataggatgggaaagctaacaaattaaagttttggcaaaaaggaatatatgtaaatagctaattatttacttttgtgcttactttatttagattatttctatcagttacaatctttttctagttaagtgtacctaatttatggaatgggtgctatcctgtttatgtgtgtcttggtttttcttggctacagaaaaactgttgcagggcaacactagtttgatatttgatttactctccaatgagactcaatggctgggccgtggtagactcatagttcctcttgttctttattaaattcatcctgctaattagatttctagtgacttgtaacatgtagtttacactgaattgcaattacagatgcatacaactactatactagaaaaaattgtcatttctgatgtgccaataaatgatttttatgagagaataaaaaaact

SEQ ID NO: 458665 - DNA, 391 bp, Homo sapiens
aatctccccggaatcctttaaaagaggcaggtgactaagaaccatataatcaaatgtcaccaggatttgagagcccaccatggtgagcagcctgttaccataggcaggattcttcttgaattccgtttaatgcctgctagcctagatgtttaaagcgaagcaaacagaacactttttgagttagggacacacccacggtacactgtgtaaagggacagggggatgcacgatgcctctcaggactcacagtctcattccccaggtcacgctgcacaccgggctcccagtccccgacttctactccagcagagcatcaatagcctaaggatgtgccgtggaggcgccagctgcctgttcttacctccgcctgcgagagccacagcaaggagct

SEQ ID NO: 458666 - DNA, 704 bp, Homo sapiens
ggctcacagagctagcgcctctctgggtgtccgtgccagtgctgcgcgggaaggcaccaccaccacagccgccgccgctggccaggctgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagc

SEQ ID NO: 458667 - DNA, 3724 bp, Homo sapiens
cagtgctgcgcgggaaggcaccaccaccacagccgccgccgctggccaggctgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagcttcctctccagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgagggtaaggcccttcagcagtatccctcagagcgagaactgcgtggcatctaaagtggctggcaagcccggaggtaaccccaccactgcccacattcctgaagtgtttccatgacttgctctgcattctgcacagagccgctgttcctctcctgcctttagagagcctatggtatgtggatgtgatcaaaccaaagattccacatcggcagttccaatggcttgggccggcggcttcctttgataacaatctaaataagctgcagttgaagaagctgaaaaatgaaggcctgaatgtgcccctggtgtgtaagacaaatgtatctaggctctagagcaggctcccattctccaccgatacacatcatgtgccagttttgcccagatgattctaaattactctgtagtacttgcttgttctgagggtgggacctaggttctttccagtcgtggatttgtatgactgaatgtgtttcaaatgggtggtggggtgctagagctgtttagagagggcctgttggctgctcctggcttacccacttagactgcctccgtttcatacccaaagcggaggccgtcagcaccaggattgagacttcctgtgggcaccaaacaggaagagaccagcaacttcgcattacccgccattttcatctttgccagtcccttcagtcttggctaggctaccgagagccaccatacaaggttcatctctagagaatttttgcttcttagctatactttaaatattttggtcatcaaagacaagtaatgtgtctcagatgagaggcttgaatttgatggccagatataacctctgaggcttttaacattttcattttaagagtaagcaagacacatgaaattaaacctacaaggaggtatttgtggctggtgccaaagcattctgacactttggggtgtcattttaatcaaagaaatcacccccccacctcaccgggattctccataacttccctctgcagaactaattatgttgattttgttcaagttcaagatgttagctaaaagaactatggtggtgttttttttcccacttcccacaaacctcaacatgtgccagtcaccctaaaatgcttcacatggttaaaaacaagcacaattttgaatcctacagcaaggatgaaaggcccctagccgtgaaaacagtgctttggggagcagttgtcagtctaagtgatgctattccaagagaaggatatgctgagggaaaatgcccacatgacctgttcccatttggagtacagtgatgtggtagctacagcttcccccagaattatcattttagcaccttctctcagggatgacctatcagtttgagagcagttgcctcttttctcaaaataccatactaactgctaaagccctccaagagtctttcctagatgcaacgcagaaggcccttgctggtgatggcctcatttcccatgtgtgtacaaggtggtttgattgaagagtgaagtgcatgcctgcagagcagagagaaatttgtagcaatgttgctaatatgtgttatcagatctgcgggaaaactatttctattcataatacatcatgggaatcatactattctggtaaaaatcagttattagcataacagcctgagcacttatgtctctcgtttcatcctgcaggaggatgtagcgcctcagtttattttaatgttcataagattatggtgtctaatttaataaattacaggattggaactgcgatccttggtaccacagtcacagaactgggggtcattttctagatgaaacaaacggaacaagttctcttccaacaaagaaactgtactgtagaaattaatttcctccatgaattttatatattgtgtacaaatataaggtatgtatctgaatacaaagaaaagcctatcatcatatagatatcagtattctctgttactgcacagaagtaattttctcatgatgaaataaagttcacacacatactttctccataa

SEQ ID NO: 458668 - DNA, 1267 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgatggacgcgtcgcgcatggggatcctct

SEQ ID NO: 458669 - DNA, 911 bp, Homo sapiens
gcacacgcgaccccacacacacacccaaacacgagacaacgaaccaactggcacgtgagtgaggcagcgtgggctatggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactccggatgtgggacatgggctcaaatagatccacagattgaaatttcaggcatttaaaagagtgcagaagtcctgggtgaacgaacattctctgaaaagggggggactcgaaaagctgaggggccggccgggaatgtccgggcggaccttggaagagccatag

SEQ ID NO: 458670 - DNA, 408 bp, Homo sapiens
ccccaccaccacatccccagttcttgtttaaatttttttcctcattcgcagcttccgcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaatgtgcaggacagcctcacgtactgaggggaagtgtgctcacagagcccccaccctcctcagctgcctccagctcaccctgctctgccccagtgcggtgttcaagacaaataaaagactttttctcattcaa

SEQ ID NO: 458671 - DNA, 457 bp, Homo sapiens
ttcctcaatggggcagcatccattgcacacccactgtgcactgcaggcattttgcaagatttgaaaaaaacaaacccaacctgctcgtaaagggccctgtatgagggtgactggcatccctttaggccactgacctgtccatgggtccactggcctcagcccctacttcccagcccacagagagcacaggaccagctctcagtcccagccccttcctcttcttacagtatgagcagcttcctcctcccccattcctccctgcctgctttccacacctgtcctcacctgttcatgctcctccctccctccccggcccttctcactcaggtgcaggacagcctcacgtactgaggggaagtgtgctcacagagcccccaccctcctcagctgcctccagctcaccctgctctgccccagtgcggtgttcaagacaaataaaagactttttctcattcaa

SEQ ID NO: 458672 - DNA, 2369 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgccacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgtgaaacacagggcctgagagtgctttacaggcattcacgtgctgtccgagtggcattcgggggctggcctagctggccctagtcctggtgtgcagggttcaggcagtcttgacctgcaacaaccgaggttttttagtcttttaacccagccattttcaattttttaaaaattaggtaagttaaaaaagctgggtaaaagctgactcagccctgtgtgcttgtgttccttagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagacaaaaaaagtctggat

SEQ ID NO: 458673 - DNA, 1960 bp, Homo sapiens
agaataactcgaaggcaacgaggttggggatagggtgagggaaaagagcaagaatcactcaagacggagaaaactgctgtcaaaagttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgccacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgtgaaacacagggcctgagagtgctttacaggcattcacgtgctgtccgagtggcattcgggggctggcctagctggccctagtcctggtgtgcagggttcaggcagtcttgacctgcaacaaccgaggttttttagtcttttaacccagccattttcaattttttaaaaattaggtaagttaaaaaagctgggtaaaagctgactcagccctgtgtgcttgtgttccttagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagacaaaaaaagtctggat

SEQ ID NO: 458674 - DNA, 2240 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgccacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgtgaaacacagggcctgagagtgctttacaggcattcacgtgctgtccgagtggcattcgggggctggcctagctggccctagtcctggtgtgcagggttcaggcagtcttgacctgcaacaaccgaggttttttagtcttttaacccagccattttcaattttttaaaaattaggtaagttaaaaaagctgggtaaaagctgactcagccctgtgtgcttgtgttccttagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagacaaaaaaagtctggat

SEQ ID NO: 458675 - DNA, 1942 bp, Homo sapiens
ggagtgatagatggaagcttccgtcatcgcctgacttagtcaccaacagtggagcggtaggagcccccgctatcctcagatgggtgctgctgagacattgggtgtttatggaggacttgagagttggcagagcaagccttgtgtgctttctttccctggctcactagcacaggctaatcatgttgtcatcatgttctaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgccacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgtgaaacacagggcctgagagtgctttacaggcattcacgtgctgtccgagtggcattcgggggctggcctagctggccctagtcctggtgtgcagggttcaggcagtcttgacctgcaacaaccgaggttttttagtcttttaacccagccattttcaattttttaaaaattaggtaagttaaaaaagctgggtaaaagctgactcagccctgtgtgcttgtgttccttagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagacaaaaaaagtctggat

SEQ ID NO: 458676 - DNA, 1680 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgcc

SEQ ID NO: 458677 - DNA, 1685 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaatgtgcaggacagcctcacgtactgaggggaagtgtgctcacagagcccccaccctcctcagctgcctccagctcaccctgctctgccccagtgcggtgttcaagacaaataaaagactttttctcattcaaaaaaaaaaaaaaaaaaaaaaaaaaaaaaaaaaaaaaagacagatgagagaaaaaaagagaaggaaataaaacaggaaaagggaacgagatgtagatgaaattgaaaaaaaaaaaaaaaaaataaatgagaggtaaaaaggaatgaaagaagtgggggtgcggattgtcaaatagggagttggggcaagacagataggagtaggggggtagatgaggcagagggtgtgatgaagggacgagagcgcgtggaggaatgtaggagagcgtccacagatgaggggggggggggggta

SEQ ID NO: 458678 - DNA, 1372 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctgggtaagtgatacacgctggggttg

SEQ ID NO: 458679 - DNA, 1396 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgatggacgcgtcgcgcatggggatcctct

SEQ ID NO: 458680 - DNA, 1794 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagaagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgccacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgtgaaacacagggcctgagagtgctttacaggcattcacgtgctgtccgagtggcattcgggggctggcctagctggccctagtcctggtgtgcagggttcaggcagtcttgacctgcaacaaccgaggttttttagtcttttaacccagccattttcaattttttaaaaattaggtaagttaaaaaagctgggtaaaagctgactcagccctgtgtgcttgtgttccttagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagacaaaaaaagtctggat

SEQ ID NO: 458681 - DNA, 1263 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaatgtgcaggacagcctcacgtactgaggggaagtgtgctcacagagcccccaccctcctcagctgcctccagctcaccctgctctgccccagtgcggtgttcaagacaaataaaagactttttctcattcaa

SEQ ID NO: 458682 - DNA, 755 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaagtcaggcggctgcgtaggctccatccacaggatcccaggcatctccgtccagccaccgttgaagccttccagcctcgtcttcatcaaccgatcacccgtt

SEQ ID NO: 458683 - DNA, 582 bp, Homo sapiens
gttcacgccattctcctgcctcagcctccggagtagctggaactacaggcacccgccgccacgcccagctaatttttttgtatttttaataaagacagggtttcaccgtgttagccaggatggtctctatctgaccttgtgatccacctgcctcagcttctcaaagtgctgggatttccacgcccgacagggggacattttaatgtgtcagctcacaaatttagaactggaagggacttgggaatctactggtccttgggttctgagactgttcctcagcaccccaggaaatctgagggttgggaatgagctcaagacagtcttggactcgccactattgtattctaccttcaagtaggatttccactggaagtcttagcagatacgtcactagccccacatcgcagagctgaagcccacatagctctgccccggtccaggcacctgctggctgcctggggcagcctgtcaactgcagtactcattgctgttctgtcctttccacaggcaatcgaaaatatcgacaccttaaccaacctggagagtttgtttttggggaaaaacaaaattactaaacttcag

SEQ ID NO: 458684 - DNA, 1392 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaatgtgcaggacagcctcacgtactgaggggaagtgtgctcacagagcccccaccctcctcagctgcctccagctcaccctgctctgccccagtgcggtgttcaagacaaataaaagactttttctcattcaa

SEQ ID NO: 458685 - DNA, 956 bp, Homo sapiens
tctacgaggcccgcgctaagggttgctagggacgcaccaaacacccctacggcgcttcggaggagccaaaggaataatgggcgcctccgcccccgggccgggcagatgcggtttcctcccgactcgcgatcaaaatggaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggataacaaaaactcttaaaggtgggcgaactcgacgagtgatggagcagaacctgacacaggcacgaaaggaaaccattagaaagccccaatac

SEQ ID NO: 458686 - DNA, 381 bp, Homo sapiens
tctacgaggcccgcgctaagggttgctagggacgcaccaaacacccctacggcgcttcggaggagccaaaggaataatgggcgcctccgcccccgggccgggcagatgcggtttcctcccgactcgcgatcaaaatgggtgagtagcgcagagctcgcctcttggaggcctctttctgaaggcggaggacgctggggcggctcgttcatgggccgggtggctccgcagggtagacgaaggctgcagcgtccgcactgggctgggaacgacttgcaaggggagcccagctggcgccccggagccagccagctggctagcggccccaccagcgcaagtgccccgcacctgcccgcctgctccgagcgtcaagagaaggcggca

SEQ ID NO: 458687 - DNA, 2015 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgccacacaccattttcagatgccgttgcaattaaatcttgccacaaaaaaaaaaaaaaaaaaaaaaaaaaaaaaaaaaaaaagacagatgagagaaaaaaagagaaggaaataaaacaggaaaagggaacgagatgtagatgaaattgaaaaaaaaaaaaaaaaaataaatgagaggtaaaaaggaatgaaagaagtgggggtgcggattgtcaaatagggagttggggcaagacagataggagtaggggggtagatgaggcagagggtgtgatgaagggacgagagcgcgtggaggaatgtaggagagcgtccacagatgaggggggggggggggta

SEQ ID NO: 458688 - DNA, 2012 bp, Homo sapiens
tctacgaggcccgcgctaagggttgctagggacgcaccaaacacccctacggcgcttcggaggagccaaaggaataatgggcgcctccgcccccgggccgggcagatgcggtttcctcccgactcgcgatcaaaatggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgccacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgtgaaacacagggcctgagagtgctttacaggcattcacgtgctgtccgagtggcattcgggggctggcctagctggccctagtcctggtgtgcagggttcaggcagtcttgacctgcaacaaccgaggttttttagtcttttaacccagccattttcaattttttaaaaattaggtaagttaaaaaagctgggtaaaagctgactcagccctgtgtgcttgtgttccttagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagacaaaaaaagtctggat

SEQ ID NO: 458689 - DNA, 1848 bp, Homo sapiens
gcacacgcgaccccacacacacacccaaacacgagacaacgaaccaactggcacgtgagtgaggcagcgtgggctatggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgccacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgtgaaacacagggcctgagagtgctttacaggcattcacgtgctgtccgagtggcattcgggggctggcctagctggccctagtcctggtgtgcagggttcaggcagtcttgacctgcaacaaccgaggttttttagtcttttaacccagccattttcaattttttaaaaattaggtaagttaaaaaagctgggtaaaagctgactcagccctgtgtgcttgtgttccttagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagacaaaaaaagtctggat

SEQ ID NO: 458690 - DNA, 2351 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgccacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgtgaaacacagggcctgagagtgctttacaggcattcacgtgctgtccgagtggcattcgggggctggcctagctggccctagtcctggtgtgcagggttcaggcagtcttgacctgcaacaaccgaggttttttagtcttttaacccagccattttcaattttttaaaaattaggtaagttaaaaaagctgggtaaaagctgactcagccctgtgtgcttgtgttccttagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagacaaaaaaagtctggat

SEQ ID NO: 458691 - DNA, 2238 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaaggattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgccacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgtgaaacacagggcctgagagtgctttacaggcattcacgtgctgtccgagtggcattcgggggctggcctagctggccctagtcctggtgtgcagggttcaggcagtcttgacctgcaacaaccgaggttttttagtcttttaacccagccattttcaattttttaaaaattaggtaagttaaaaaagctgggtaaaagctgactcagccctgtgtgcttgtgttccttagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagacaaaaaaagtctggat

SEQ ID NO: 458692 - DNA, 1377 bp, Homo sapiens
atgcgcgacgcttccatcaagctgccattgactttcttcacagaattagaaaaaaactactttaaatttcatatggaaccaaaaaagaacccatatagccaagacagtcctaagcagagaacaaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaataacaaactcacgatgttggacattgcatcaaatagaatcaaaaagattgaaaatatcagccatctaacagagctgcaagagttctggatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgccacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgtgaaacacagggcctgagagtgctttacaggcattcacgtgctgtccgagtggcattcgggggctggcctagctggccctagtcctggtgtgcagggttcaggcagtcttgacctgcaacaaccgaggttttttagtcttttaacccagccattttcaattttttaaaaattaggtaagttaaaaaagctgggtaaaagctgactcagccctgtgtgcttgtgttccttagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagacaaaaaaagtctggat

SEQ ID NO: 458693 - DNA, 1570 bp, Homo sapiens
  misc_feature (1162)..(1162): n is a, c, g, or t
  misc_feature (1200)..(1200): n is a, c, g, or t
  misc_feature (1260)..(1260): n is a, c, g, or t
  misc_feature (1316)..(1317): n is a, c, g, or t
  misc_feature (1323)..(1323): n is a, c, g, or t
  misc_feature (1336)..(1336): n is a, c, g, or t
  misc_feature (1373)..(1373): n is a, c, g, or t
  misc_feature (1375)..(1375): n is a, c, g, or t
  misc_feature (1379)..(1379): n is a, c, g, or t
  misc_feature (1381)..(1381): n is a, c, g, or t
  misc_feature (1383)..(1383): n is a, c, g, or t
  misc_feature (1393)..(1393): n is a, c, g, or t
  misc_feature (1407)..(1407): n is a, c, g, or t
  misc_feature (1491)..(1491): n is a, c, g, or t
  misc_feature (1495)..(1495): n is a, c, g, or t
  misc_feature (1519)..(1519): n is a, c, g, or t
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgaggtactgaagaaagtgaagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagccacnccaaccccctcaccaacatccaccctctccacaacctnctcaactcccccacctctaccttacccacaatcccatccacctcatccaccccctccacnacaatcacacactcaccatcttccacattccatcaaatacaatcaaaaacattcannatctcncccatctcacacncctccaacacttctccatcaaccacaatctccttcananctgnancnacctccaccncctcaacccacccnccaccctccacacactctacctccaccccaaccccttccacaaccacccccactacccccccaacctcatcctccccctccccncccncccccacatccatcccaccttccncaccttctcactccttcttgccctcctcatctcctccctctcctccccacc

SEQ ID NO: 458694 - DNA, 1374 bp, Homo sapiens
ggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggaggttgacaggcgggtcgagtctgaagaatccggcgatgaagaagggaagaaacacagcagtggcatcgtggccgacctcagtgaacagagcctgaaggatggggaggagcggggggaggaggacccagaagaagaacatgagctgcctgtggacatggaaaccatcaacctggacagagatgcagaggatgttgatttgaatcactatcgcatagggaagattgaaggatttgagactctctgcctccgccaaaatttaattaaatgcattgagaatctggaggagctacagagtcttcgagagctggatctttacgacaaccagatcaagaagattgagaatctggaggcgctaacagagctggagattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggcaatcgaaaatatcgacaccttaaccaacctggagagtttgtttttggggaaaaacaaaattactaaacttcagaacctggatgcgctcaccaacctgacagtcctcagtatgcagagcaaccggctgaccaagatcgagggtctgcagaacctggtgaacctgcgggagctgtaccttagccacaatggcatcgaggtcatcgagggcctggagaacaatgtgcaggacagcctcacgtactgaggggaagtgtgctcacagagcccccaccctcctcagctgcctccagctcaccctgctctgccccagtgcggtgttcaagacaaataaaagactttttctcattcaa

SEQ ID NO: 458695 - DNA, 532 bp, Homo sapiens
catgtccacctaatttttgtatttttagtagagacggggttttgccatgttggtcaggctggtcttgaactcctgacctcaggtgatccacccacctcggctcccaaagtgctgggattacaggcatgagccaccgtgcccggccaaggctgagacttttctggtccaagacctagatctttggtttcaaatgagagttatttctgatgtcatccattcaataaatatttattatgcgcctgttctgtacctggccttgtgccgagcagtgctgaggacaggcctggccctggggttccctacctagatgaggaggcagacacgtaaacaataagttaaatatgggattataaaatgtgataagggctatgaagaaaccttggggtcaatgatatttaataacagggtggggatacgagaactagtgagatagaatgggaaggaaaattccctttttgtttttggaggcagagtctcattctgtcgcctacactggagtgcagtggcgtgatctaggcttactgcaacctcc

SEQ ID NO: 458696 - DNA, 1369 bp, Homo sapiens
cacgaggagagacccacgcccctcccatcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaaga

SEQ ID NO: 458697 - DNA, 231 bp, Homo sapiens
aggaggtaggaagagagggaggaggaaaggaagcatagatgcctcaggcttcaggccttacatgggttttcagggccaacataaatgtaaatactcctgattactcccctaatcccctactccctccaccccccctccactgtaggccactggatggtcatttgcatctccgtaaatgtgctctgctcctcagctgagagagaaaaaaataaactgtatttggctgcaaga

SEQ ID NO: 458698 - DNA, 1203 bp, Homo sapiens
agtaaatggggtgggtcattaacaacgagaacatccaaataattaaaaagctccttcccatttcttcctggtaacacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaaga

SEQ ID NO: 458699 - DNA, 903 bp, Homo sapiens
cacgaggagagacccacgcccctcccatcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctcagtagccacagggatcctctagaacgctacacca

SEQ ID NO: 458700 - DNA, 1422 bp, Homo sapiens
cacgaggagagacccacgcccctcccatcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaagaaataattctataatataatttatattatgtggatatatctacagtaaaaactc

SEQ ID NO: 458701 - DNA, 927 bp, Homo sapiens
gggtgatctagaggatccttcatgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaaga

SEQ ID NO: 458702 - DNA, 6661 bp, Homo sapiens
tagctaggcatggtggtgcgtgcctgtagtcccaggtacttgggaggctaaggtgtgaggatcacctgagcctgagcctgggaagtcaaggctgcagtgagccgagatttttgtgccactgcactctagcctgggtgatgagagtgagacccaagaaataaagaagaaagagaaaaagaaaaaaggaaggaaggaaggaaagagaggagaggagaggagagaggaggagagaaggagagaaggaggaagggagggaaggaaggaaggaaggaaggtcaataattggctttcatggtttgatttcagtcccatacattaaagaaaaaaattttttaaaggtcttagcccactggctgtgggtcctgcccccaggtggttttcagtcgtctccctcatgattccagcggccatagccatctcgttcctctggctcttcgatactctcattctcaaaggaggcctcttcctcctcttcttcccgtattaccttcattagctcaaggaagctggggggcgggccctgatccttcagctccctaagccggcaccacagcatctggttaagagtggccccagccatgacctgctccaggcggacctggtccgcaatacgccgagggatggcgcgtttctccaccgctctccggagcagggtttctagccgtaacacataggctgagaccttctctccttcctcctgataggtcttcagatacctcacctgggctgtcctgcggctctctaggctcccaaacacttgcttaaaggcctccaaacactcttctacactgatggacgggttgtctgcctgcactatgtgcatgaggtccagggcagggccccgcaggctttccgccagccaccttttcttttctgcctctgttactggccactctttgactatctccgtggcctgttccaaccagacctcaaaggactcttcctctggggctgggacagcactccctgagaatactcgcagtttccggtatctcatgggtagcaggggctgaggcgcatgtgccattgcctgtcccaacaaatgggccagtaattctggtgagatgcagggcactgtggctggagacacgccctcctgccccagggctcgaaacatacccgagaccgtctgcccctctttttctagaaacaggttcaatctttcaagaaactcagtgtcctgattaggggtcttaaagatcaccttccagacacccccctttccctggacctcactgggaatggccgagacatcagtatcttccagaagctctagtaagacagcattggcattctcctgcttccggaatatcttgccaagcagtctatacctgcccagagactttaaagtctcctgaaggacctcctgaatctcagcctcctcaaagtccgccggtatccccgtaaccatcagtgacttctgctcatccacactcattatcctgcaccagtcctctaacagtgccagggccattgtcctaagaattgacccactctgactctacaggcaccaatttgttagtggtgcagctatgcactgacttaatattgaaaatatcctggatgagcttctaaccttagaacccaccaatgaatgggtcccagactaggtcactcaaagacagtcacaaagttttctggacaaattgaccctggcctactcagtggcaagaactcaggacttcttgtctttaggcctgacccaggtgggcaggtcgtatctcagttctactcagggtcagtgtggtacgttcaatccacaggctcttgaattcattctccttgtccttggggcctttgtgaaaaggcctgtcataccgaaaactacacagaggccgcatttaccctgctcctttactgtgagctgctgcagtgggaggaccggccactacgggaattcctccactacccatcgcagacagagtggcagcggaaggagggactgtgccggaagatcattcactacttcaacaaaggcaagagctgggagtttgggatcccactgtgcagggagctggcgtgtcagtacgagagcctctatgattaccagagcctcagctggattcggaaaatggaggccagctactatgacaacattatggagcagcaacgcctggagcctgagttctttcgggtcggcttctatggcaggaagtttcctttctttcttcggaacaaagaatacgtgtgccgtggccatgactacgagaggctggaggccttccagcagaggatgctcagtgagtttccgcaggctgtcgccatgcagcaccccaaccatcctgatgacgccatcctacagtgcgatgcccagtacttgcagatctatgcagtgacgcccattccagattatgtggatgttctgcagatggatagggtaccagatcgagtcaagagcttctatcgcgtcaacaatgtgaggaagttccggtatgacaggccttttcacaaaggccccaaggacaaggagaatgaattcaagagcctgtggattgaacgtaccacactgaccctgacccacagcttgcctggcatctctcggtggtttgaagtggagaggagggaactggtggaggtgagccctctggagaatgccatccaagtggttgagaataagaaccaggagctacgctccctgatcagccagtatcaacacaagcaggtgcatggcaacattaacctgctaagcatgtgcctgaatggtgtcattgatgcagctgtcaatggaggcattgcacgctatcaggaggccttctttgataaagattacatcaacaagcacccaggagatgctgagaagatcacccagctcaaggagcttatgcaggagcaggttcatgtccttggagttgggctagcagttcatgagaagtttgtgcacccagaaatgcggcctctgcataagaagctaattgatcagttccagatgatgcgggccagtctctaccatgagtttccaggtttggataagctaagtcctgcatgttcaggcaccagcaccccacggggaaatgttctggcatcccatagccccatgagtccggagagcatcaagatgacccaccggcacagtgaagcaggaaacatggtgatgctgggtgacggctccatgggtgatgctcctgaggacctgtaccaccacatgcagctcgcgtatcccaaccccaggtaccaaggctcagtcaccaacgtctctgttctgtcctcgtcccaggcaagcccttcttcctccagcctgagttccactcactcagcaccatcccagatgattacctctgccccttccagtgcccgaggctctccctctctgccagataagtaccgccatgcccgtgaaatgatgttgttgctgcccacataccgggaccgcccaagcagtgccatgtatccagcagccatcctggagaacggacagccgccgaatttccagcgagccctgttccagcaagtggtcggagcctgcaaaccctgcagtgatcccaatctgtctgtggctgaaaaagtctcctctccaccctatcccagcctcccccacaagcccccagtcaggtctggacggcagcaactctacgctgtccggcagtgccagcagcggcgtgtcctccttgagtgagagtaactttgggcactcctcggaggccccacctcgcactgacaccatggactccatgccaagtcaggcctggaatgctgacgaagatcttgagccaccctacctccctgtccactacagcctctctgagtctgccgtcctggactccatcaaggcccagccatgccgaagccactcagccccagggtgcgtcatccctcaggaccccatggacccgcctgcgctgccgcccaagccctaccacccccgcctgccggccctggagcacgatgagggggtgctgctgcgtgaagagactgagaggcctcgaggcctgcaccgcaaggctccattgcctcctgggagcgctaaggaggagcaggcccgcatggcctgggagcacggccgaggggagcagtgaggggcaacgaggcggctgggatgccgccctcagtaagcagcttgccaatcactccaggtctgaaaagcaagtcccccagccccaccccagggagccagagaggcttgcactcaggagagaaccacccccaagtctccgttctactgccgtgaactcatgtgttgccatgtacagaggccacagcagcatgaagggttgtggcttccctttttatttttttacatttccatttctatgggttttcctttctttcctttatgcagtagatgctttcttcctcctgcagttctggaccatgtggagctacatggagaaattgcacagacagaatcactttgccacactgcagggcccaggagtgggagcccaggccctccctccagggtagagatgcaccgaatggaaattgcactaaggacctcttcctttgctgtatggacagaagagttcatggttgcattcagggattgcaaggaccatatagacatgtcacaggtggaaaaagggccacaagccgttttgcacaaatgcctgcccacctgcccctcttccatccaggagtgtgctactgaggggctggctggaccaacctgctggctcaggcatgtgactggcctaactgcatgcccagggcactgccagggttcaatgggccagccgtctcctactccaccttggatttttctctccatcacatcatttctgaccatttgctcccttccattcttgaaacacctcatgccccacaggagccccagtggtgactggatctgcaagggttatctcccgccctctggggtttgagtggaggtatggagccagagaggctatcctagctaccttcctcctagggggagctggtccccttcctatgtggtagagagactggtgtaagagtgtggggtgtggcaggcgccggaaatcctcaaagctttcagaagcatccagaatgcctaccatcagctcctgaatcagggattttcagcactacctctgagccatggggttggctgcccagccaggcttccaggccctgaggacatgtggtcaggttcagcaggctcctgggtaaagagggtgggagggggcttctccttttggaagcagatagccatgcaggtagaattgtcatctcccaagtggccacatacagcaacccactccaggccatggggaccaccactcagggttcggggctggcaggagggtagtttctccagtctccccagtctgttggtgtctttataggaaactataaagcagagcagtggtgtctttagaggaaactcattcaagtcagggcactgattttcctctcagtttattatttggggggatagggtcaggtgggtatagtagtactttaccagggtgcttttaagttactttaaaaaaagcctacaaaatattttttttcttttatttgctcgagttcacattaatgatggtcacaaggctgccttgttgggcaggcgtattgcccccagttcctcttctgctggcctgtatgacctccacagccaggccctgggcccaagccccttgtcccttctccactgcccctctttccagacagtaaaggccatggtcagtgtgtttttctcttgtaaacaaaccccagcttgtttaacagaaatgctaataacctactgggaaagatggaggtctaaattacctccagggtttttctgggggtttatcaccagtgtgggtcccttctgataccaccaggttcactccaggcagagtggggcggaaggctgctgaggatatgggtcagttacagcagccctcacctcaaagggctggcctgcttctcagcctacattcatttgcaagcttcaatctctggaccatctggtgttcacaggtgttagagggttaggggttaggggctagttttggatttgattcataggtaggagggcttagattttaaggcacttctgaaagtcaatccctggacaaggcagtcatcacataagaacagctaccttctccacttggtggcacaagaggtagggaggggagtatgggttcatttggcttcgcattatgcaaggtgaaaccgtttgttttccctctccattttccctaactaaatgaaaaggacacattctgaaatcccttttgttggagaataagtcagtctgaggggaaatgggaggccagagatgagaaccctttgaaaagattgtaaaatactgattttcattctttcaagcttatttgtaaatacctatttgaatgctgtgtatttgtacaggaatttgagcaaaaaatgtatagagtgtgatgtccaattggtattcagcactataaatgtgtttttaacctcccgcattctgtgcttatttaaaacaaggaaacttctaaccatttcttttgtgtattcatgtttaaagaaaaaaagtgatttaaaaatgatcttacctgtaccagaaaagcaaagttaaaggaaacaaaatttgtaccattgtcccaagaggtattttactgtatatattgtggtagcatgttcaaaatccaacaagtaatgtgaattttagatgtaaatatctgccacttgattttttttccccctttccccacttccttgactgctgtgatgtgaattaaagataaatacgtgatactgatccactgaa

SEQ ID NO: 458703 - DNA, 6199 bp, Homo sapiens
tagctaggcatggtggtgcgtgcctgtagtcccaggtacttgggaggctaaggtgtgaggatcacctgagcctgagcctgggaagtcaaggctgcagtgagccgagatttttgtgccactgcactctagcctgggtgatgagagtgagacccaagaaataaagaagaaagagaaaaagaaaaaaggaaggaaggaaggaaagagaggagaggagaggagagaggaggagagaaggagagaaggaggaagggagggaaggaaggaaggaaggaaggtcaataattggctttcatggtttgatttcagtcccatacattaaagaaaaaaattttttaaaggtcttagcccactggctgtgggtcctgcccccaggtggttttcagtcgtctccctcatgattccagcggccatagccatctcgttcctctggctcttcgatactctcattctcaaaggaggcctcttcctcctcttcttcccgtattaccttcattagctcaaggaagctggggggcgggccctgatccttcagctccctaagccggcaccacagcatctggttaagagtggccccagccatgacctgctccaggcggacctggtccgcaatacgccgagggatggcgcgtttctccaccgctctccggagcagggtttctagccgtaacacataggctgagaccttctctccttcctcctgataggtcttcagatacctcacctgggctgtcctgcggctctctaggctcccaaacacttgcttaaaggcctccaaacactcttctacactgatggacgggttgtctgcctgcactatgtgcatgaggtccagggcagggccccgcaggctttccgccagccaccttttcttttctgcctctgttactggccactctttgactatctccgtggcctgttccaaccagacctcaaaggactcttcctctggggctgggacagcactccctgagaatactcgcagtttccggtatctcatgggtagcaggggctgaggcgcatgtgccattgcctgtcccaacaaatgggccagtaattctggtgagatgcagggcactgtggctggagacacgccctcctgccccagggctcgaaacatacccgagaccgtctgcccctctttttctagaaacaggttcaatctttcaagaaactcagtgtcctgattaggggtcttaaagatcaccttccagacacccccctttccctggacctcactgggaatggccgagacatcagtatcttccagaagctctagtaagacagcattggcattctcctgcttccggaatatcttgccaagcagtctatacctgcccagagactttaaagtctcctgaaggacctcctgaatctcagcctcctcaaagtccgccggtatccccgtaaccatcagtgacttctgctcatccacactcattatcctgcaccagtcctctaacagtgccagggccattgtcctaagaattgacccactctgactctacaggcaccaatttgttagtggtgcagctatgcactgacttaatattgaaaatatcctggatgagcttctaaccttagaacccaccaatgaatgggtcccagactaggtcactcaaagacagtcacaaagttttctggacaaattgaccctggcctactcagtggcaagaactcaggacttcttgtctttaggcctgacccaggtgggcaggtcgtatctcagttctactcagggtcagtgtggtacgttcaatccacaggctcttgaattcattctccttgtccttggggcctttgtgaaaaggcctgtcataccgaaaactacacagaggccgcatttaccctgctcctttactgtgagctgctgcagtgggaggaccggccactacgggaattcctccactacccatcgcagacagagtggcagcggaaggagggactgtgccggaagatcattcactacttcaacaaaggcaagagctgggagtttgggatcccactgtgcagggagctggcgtgtcagtacgagagcctctatgattaccagagcctcagctggattcggaaaatggaggccagctactatgacaacattatggagcagcaacgcctggagcctgagttctttcgggtcggcttctatggcaggaagtttcctttctttcttcggaacaaagaatacgtgtgccgtggccatgactacgagaggctggaggccttccagcagaggatgctcagtgagtttccgcaggctgtcgccatgcagcaccccaaccatcctgatgacgccatcctacagtgcgatgcccagtacttgcagatctatgcagtgacgcccattccagattatgtggatgttctgcagatggatagggtaccagatcgagtcaagagcttctatcgcgtcaacaatgtgaggaagttccggtatgacaggccttttcacaaaggccccaaggacaaggagaatgaattcaagagcctgtggattgaacgtaccacactgaccctgacccacagcttgcctggcatctctcggtggtttgaagtggagaggagggaactggtggaggtgagccctctggagaatgccatccaagtggttgagaataagaaccaggagctacgctccctgatcagccagtatcaacacaagcaggtgcatggcaacattaacctgctaagcatgtgcctgaatggtgtcattgatgcagctgtcaatggaggcattgcacgctatcaggaggccttctttgataaagattacatcaacaagcacccaggagatgctgagaagatcacccagctcaaggagcttatgcaggagcaggttcatgtccttggagttgggctagcagttcatgagaagtttgtgcacccagaaatgcggcctctgcataagaagctaattgatcagttccagatgatgcgggccagtctctaccatgagtttccaggtttggataagctaagtcctgcatgttcaggcaccagcaccccacggggaaatgttctggcatcccatagccccatgagtccggagagcatcaagatgacccaccggcacagtgaagcaggaaacatggtgatgctgggtgacggctccatgggtgatgctcctgaggacctgtaccaccacatgcagctcgcgtatcccaaccccaggtaccaaggctcagtcaccaacgtctctgttctgtcctcgtcccaggcaagcccttcttcctccagcctgagttccactcactcagcaccatcccagatgattacctctgccccttccagtgcccgaggctctccctctctgccagataagtaccgccatgcccgtgaaatgatgttgttgctgcccacataccgggaccgcccaagcagtgccatgtatccagcagccatcctggagaacggacagccgccgaatttccagcgagccctgttccagcaagtggtcggagcctgcaaaccctgcagtgatcccaatctgtctgtggctgaaaaagtctcctctccaccctatcccagcctcccccacaagcccccagtcaggtctggacggcagcaactctacgctgtccggcagtgccagcagcggcgtgtcctccttgagtgagagtaactttgggcactcctcggaggccccacctcgcactgacaccatggactccatgccaagtcaggcctggaatgctgacgaagatcttgagccaccctacctccctgtccactacagcctctctgagtctgccgtcctggactccatcaaggcccagccatgccgaagccactcagccccagggtgcgtcatccctcaggaccccatggacccgcctgcgctgccgcccaagccctaccacccccgcctgccggccctggagcacgatgagggggtgctgctgcgtgaagagactgagaggcctcgaggcctgcaccgcaaggctccattgcctcctgggagcgctaaggaggagcaggcccgcatggcctgggagcacggccgaggggagcagtgaggggcaacgaggcggctgggatgccgccctcagtaagcagcttgccaatcactccaggtctgaaaagcaagtcccccagccccaccccagggagccagagaggcttgcactcaggagagaaccacccccaagtctccgttctactgccgtgaactcatgtgttgccatgtacagaggccacagcagcatgaagggttgtggcttccctttttatttttttacatttccatttctatgggttttcctttctttcctttatgcagtagatgctttcttcctcctgcagttctggaccatgtggagctacatggagaaattgcacagacagaatcactttgccacactgcagggcccaggagtgggagcccaggccctccctccagggtagagatgcaccgaatggaaattgcactaaggacctcttcctttgctgtatggacagaagagttcatggttgcattcagggattgcaaggaccatatagacatgtcacaggtggaaaaagggccacaagccgttttgcacaaatgcctgcccacctgcccctcttccatccaggagtgtgctactgaggggctggctggaccaacctgctggctcaggcatgtgactggcctaactgcatgcccagggcactgccagggttcaatgggccagccgtctcctactccaccttggatttttctctccatcacatcatttctgaccatttgctcccttccattcttgaaacacctcatgccccacaggagccccagtggtgactggatctgcaagggttatctcccgccctctggggtttgagtggaggtatggagccagagaggctatcctagctaccttcctcctagggggagctggtccccttcctatgtggtagagagactggtgtaagagtgtggggtgtggcaggcgccggaaatcctcaaagctttcagaagcatccagaatgcctaccatcagctcctgaatcagggattttcagcactacctctgagccatggggttggctgcccagccaggcttccaggccctgaggacatgtggtcaggttcagcaggctcctgggtaaagagggtgggagggggcttctccttttggaagcagatagccatgcaggtagaattgtcatctcccaagtggccacatacagcaacccactccaggccatggggaccaccactcagggttcggggctggcaggagggtagtttctccagtctccccagtctgttggtgtctttataggaaactataaagcagagcagtggtgtctttagaggaaactcattcaagtcagggcactgattttcctctcagtttattatttggggggatagggtcaggtgggtatagtagtactttaccagggtgcttttaagttactttaaaaaaagcctacaaaatattttttttcttttatttgctcgagttcacattaatgatggtcacaaggctgccttgttgggcaggcgtattgcccccagttcctcttctgctggcctgtatgacctccacagccaggccctgggcccaagccccttgtcccttctccactgcccctctttccagacagtaaaggccatggtcagtgtgtttttctcttgtaaacaaaccccagcttgtttaacagaaatgctaataacctactgggaaagatggaggtctaaattacctccagggtttttctgggggtttatcaccagtgtgggtcccttctgataccaccaggttcactccaggcagagtggggcggaaggctgctgaggatatgggtcagttacagcagccctcacctcaaagggctggcctgcttctcagcctacattcatttgcaagcttcaatctctggaccatctggtgttcacaggtgttagagggttaggggttaggggctagttttggatttgattcataggtaggagggcttagattttaaggcacttctgaaagtcaatccctggacaaggcagtcatcacataagaacagctaccttctccacttggtggcacaagaggtagggaggggagtatgggttcatttggcttcgcattatgcaaggtgaaaccgtttgttttccctctccattttccctaactaaatgaaaaggaaaacaaacggttcaccttgcagtcgaccggccgcgaatttagtagtagtagtagtagtagtagtcggcggccgc

SEQ ID NO: 458704 - DNA, 2807 bp, Homo sapiens
tcatagaggatccccatatggatacgcggataaggggtgctgctgcgtgaagagactgagaggcctcgaggcctgcaccgcaaggctccattgcctcctgggagcgctaaggaggagcaggcccgcatggcctgggagcacggccgaggggagcagtgaggggcaacgaggcggctgggatgccgccctcagtaagcagcttgccaatcactccaggtctgaaaagcaagtcccccagccccaccccagggagccagagaggcttgcactcaggagagaaccacccccaagtctccgttctactgccgtgaactcatgtgttgccatgtacagaggccacagcagcatgaagggttgtggcttccctttttatttttttacatttccatttctatgggttttcctttctttcctttatgcagtagatgctttcttcctcctgcagttctggaccatgtggagctacatggagaaattgcacagacagaatcactttgccacactgcagggcccaggagtgggagcccaggccctccctccagggtagagatgcaccgaatggaaattgcactaaggacctcttcctttgctgtatggacagaagagttcatggttgcattcagggattgcaaggaccatatagacatgtcacaggtggaaaaagggccacaagccgttttgcacaaatgcctgcccacctgcccctcttccatccaggagtgtgctactgaggggctggctggaccaacctgctggctcaggcatgtgactggcctaactgcatgcccagggcactgccagggttcaatgggccagccgtctcctactccaccttggatttttctctccatcacatcatttctgaccatttgctcccttccattcttgaaacacctcatgccccacaggagccccagtggtgactggatctgcaagggttatctcccgccctctggggtttgagtggaggtatggagccagagaggctatcctagctaccttcctcctagggggagctggtccccttcctatgtggtagagagactggtgtaagagtgtggggtgtggcaggcgccggaaatcctcaaagctttcagaagcatccagaatgcctaccatcagctcctgaatcagggattttcagcactacctctgagccatggggttggctgcccagccaggcttccaggccctgaggacatgtggtcaggttcagcaggctcctgggtaaagagggtgggagggggcttctccttttggaagcagatagccatgcaggtagaattgtcatctcccaagtggccacatacagcaacccactccaggccatggggaccaccactcagggttcggggctggcaggagggtagtttctccagtctccccagtctgttggtgtctttataggaaactataaagcagagcagtggtgtctttagaggaaactcattcaagtcagggcactgattttcctctcagtttattatttggggggatagggtcaggtgggtatagtagtactttaccagggtgcttttaagttactttaaaaaaagcctacaaaatattttttttcttttatttgctcgagttcacattaatgatggtcacaaggctgccttgttgggcaggcgtattgcccccagttcctcttctgctggcctgtatgacctccacagccaggccctgggcccaagccccttgtcccttctccactgcccctctttccagacagtaaaggccatggtcagtgtgtttttctcttgtaaacaaaccccagcttgtttaacagaaatgctaataacctactgggaaagatggaggtctaaattacctccagggtttttctgggggtttatcaccagtgtgggtcccttctgataccaccaggttcactccaggcagagtggggcggaaggctgctgaggatatgggtcagttacagcagccctcacctcaaagggctggcctgcttctcagcctacattcatttgcaagcttcaatctctggaccatctggtgttcacaggtgttagagggttaggggttaggggctagttttggatttgattcataggtaggagggcttagattttaaggcacttctgaaagtcaatccctggacaaggcagtcatcacataagaacagctaccttctccacttggtggcacaagaggtagggaggggagtatgggttcatttggcttcgcattatgcaaggtgaaaccgtttgttttccctctccattttccctaactaaatgaaaaggacacattctgaaatcccttttgttggagaataagtcagtctgaggggaaatgggaggccagagatgagaaccctttgaaaagattgtaaaatactgattttcattctttcaagcttatttgtaaatacctatttgaatgctgtgtatttgtacaggaatttgagcaaaaaatgtatagagtgtgatgtccaattggtattcagcactataaatgtgtttttaacctcccgcattctgtgcttatttaaaacaaggaaacttctaaccatttcttttgtgtattcatgtttaaagaaaaaaagtgatttaaaaatgatcttacctgtaccagaaaagcaaagttaaaggaaacaaaatttgtaccattgtcccaagaggtattttactgtatatattgtggtagcatgttcaaaatccaacaagtaatgtgaattttagatgtaaatatctgccacttgattttttttccccctttccccacttccttgactgctgtgatgtgaattaaagataaatacgtgatactgatccactgaa

SEQ ID NO: 458705 - DNA, 8063 bp, Homo sapiens
gacctgcgaaggcagctactgtctggtcacctgactcaggatcaggtgcgggaggttaagcggcacatcaccgtgcgcctggactggggtaatgaacatttgggcctggacctggtgcctcggaaggactttgaagtagtggactcggaccagattagtgtctcagatctctataagatgcatttatctagccggcagagtgtacagcaaagcacatcccaggtagatacaatgcgcccacgtcatggggaaacatgtcggatgccagtgccacatcacttcttcctcagcctgaagagtttcacttacaatactattggggaagataccgatgtcttcttttccttatatgacatgagggaaggcaagcagatcagtgagcggtttctggtaagactgaacaagaatggtgggccgaggaacccagagaagatagaacgaatgtgtgccctttttacagatctgagcagcaaagatatgaagagagatttgtatatcgttgcccatgtgatccgaataggccggatgctcctgaacgactcaaagaaaggtcctcctcacctgcactacaggcgaccatatggctgtgcggtcctaagcatcttggatgtcctacagtcactcacagaagtaaaggaagaaaaggattttgttcttaaggtttacacgtgcaacaacgagagtgagtggtcccagatccacgagaacatcatccgaaagtccagtgccaagtactctgcccccagcgccagccatggtcttatcatttctctgcagcttcttcgtggagacatggaacagattcggagagaaaatcccatgatatttaataggggattggcaattacaagaaaattgggatttcctgatgtcattatgccaggtgatatccgcaatgacctgtacctaaccctggagaagggggatttcgagagaggaggaaagagtgtacaaaagaatattgaagtgaccatgtatgtgctttatgcagatggagaaatcttgaaggattgcatcagcttgggttcaggagagccaaataggagttcctaccactcctttgtcctctaccacagtaatagtcctcgctggggagaaattatcaaattgcctatccccattgaccggttccggggctcccacctgcgctttgagttcagacattgttccacaaaggacaaaggggaaaagaaactctttggctttgcattctcaaccctgatgcgtgatgatggcaccaccctctcagatgatattcacgagctttatgtgtacaagtgtgatgagaatagcacgtttaataaccatgctctgtacctgggcctgccctgctgcaaagaggactacaatggctgccctaatattccttctagcctcatcttccagcgcagcaccaaagagtctttcttcatctccactcagctctcctctaccaaactcacccagaatgtggacctcctagctctgctgaagtggaaagccttccccgaccggatcatggatgtactagggcggctgcggcatgtcagtggggaggaaattgttaagtttctgcaggacatcttagatacactctttgtgattttggatgataatacagagaagtacggcctgttggtttttcagtctctggtgttcatcatcaacctgctccgagacatcaagtattttcactttcgacctgtgatggacacgtatatccagaagcactttgctggagctctggcatacaaggagctcatccgctgtttgaagtggtatatggactgctcagcagaactgattcgacaggaccacattcaagaagctatgcgggccttggagtaccttttcaagttcattgtacagtcacggatcctgtactcacgagccacttgtggaatggaagaggaacaattcagatccagtatccaagaacttttccagtccatccggtttgtgctcagtctggacagccgaaactcagaaacactcctttttactcaggctgcactcctcaattctttcccaaccatctttgatgagcttctgcaaatgttcaccgtgcaagaggtggcagagtttgtgagagggacactggggagcatgcccagcactgtgcacattgggcagtcaatggacgtggtcaagctgcagtccattgccaggacagtggatagccgcctgttttctttctcagaatcccgccgcatcctgcttcctgtggttctccatcacattcaccttcacctgaggcagcagaaagagctgctaatttgctcagggattcttggcagcatcttctccatcgtcaagaccagctctctggaggcagatgtcatggaggaagtagagatgatggtggagagcctcctggacgtgctcttgcagactctgctcaccatcatgagcaaatcgcacgctcaggaggcggtaagagggcagcggtgcccgcagtgcacagccgagatcactggcgagtatgtgtcctgccttctctcactgctccgccagatgtgtgacacccatttccagcacctcctggacaacttccagagcaaagatgaactcaaggaatttctgctgaagattttttgcgtgttccggaacctgatgaagatgagtgtcttccctcgggactggatggtaatgagactgctcacaagcaatattatagtcactactgtccagtacctgtcctctgcactgcacaagaatttcacagagactgactttgactttaaggtgtggaattcttactttagcctggcagttctattcataaatcagccaagccttcagctagaaattatcacctcagccaaaaggaagaagattctagataagtatggggacatgcgtgtaatgatggcctatgaactgttcagcatgtggcagaatttgggtgaacataagatccactttattccgggaatgattggtccttttctgggtgtgacactggtcccacagccagaagtacggaatatcatgattcccatctttcatgacatgatggactgggagcagagaaaaaatggcaacttcaaacaggtggaggccgagttgattgacaagctggacagcatggtgtcagaagggaaaggtgacgagagctacagggagctcttcagcctactaacccagctgtttgggccctaccccagcctgctggagaaggttgaacaagaaacatggcgcgagaccggcatttcctttgtgacctcagtcacccgcctcatggaacgtcttcttgactacagggactgcatgaaaggagaggaaacagagaataagaagataggctgcactgttaacctgatgaatttttacaaatctgagattaacaaggaagaaatgtatatccgctacatccataagctttgtgacatgcacttgcaggccgaaaactacacagaggccgcatttaccctgctcctttactgtgagctgctgcagtgggaggaccggccactacgggaattcctccactacccatcgcagacagagtggcagcggaaggagggactgtgccggaagatcattcactacttcaacaaaggcaagagctgggagtttgggatcccactgtgcagggagctggcgtgtcagtacgagagcctctatgattaccagagcctcagctggattcggaaaatggaggccagctactatgacaacattatggagcagcaacgcctggagcctgagttctttcgggtcggcttctatggcaggaagtttcctttctttcttcggaacaaagaatacgtgtgccgtggccatgactacgagaggctggaggccttccagcagaggatgctcagtgagtttccgcaggctgtcgccatgcagcaccccaaccatcctgatgacgccatcctacagtgcgatgcccagtacttgcagatctatgcagtgacgcccattccagattatgtggatgttctgcagatggatagggtaccagatcgagtcaagagcttctatcgcgtcaacaatgtgaggaagttccggtatgacaggccttttcacaaaggccccaaggacaaggagaatgaattcaagagcctgtggattgaacgtaccacactgaccctgacccacagcttgcctggcatctctcggtggtttgaagtggagaggagggaactggtggaggtgagccctctggagaatgccatccaagtggttgagaataagaaccaggagctacgctccctgatcagccagtatcaacacaagcaggtgcatggcaacattaacctgctaagcatgtgcctgaatggtgtcattgatgcagctgtcaatggaggcattgcacgctatcaggaggccttctttgataaagattacatcaacaagcacccaggagatgctgagaagatcacccagctcaaggagcttatgcaggagcaggttcatgtccttggagttgggctagcagttcatgagaagtttgtgcacccagaaatgcggcctctgcataagaagctaattgatcagttccagatgatgcgggccagtctctaccatgagtttccaggtttggataagctaagtcctgcatgttcaggcaccagcaccccacggggaaatgttctggcatcccatagccccatgagtccggagagcatcaagatgacccaccggcacagccccatgaacttgatgggcacaggccgccattcatcatcctctctctcctcacatgcgtctagtgaagcaggaaacatggtgatgctgggtgacggctccatgggtgatgctcctgaggacctgtaccaccacatgcagctcgcgtatcccaaccccaggtaccaaggctcagtcaccaacgtctctgttctgtcctcgtcccaggcaagcccttcttcctccagcctgagttccactcactcagcaccatcccagatgattacctctgccccttccagtgcccgaggctctccctctctgccagataagtaccgccatgcccgtgaaatgatgttgttgctgcccacataccgggaccgcccaagcagtgccatgtatccagcagccatcctggagaacggacagccgccgaatttccagcgagccctgttccagcaagtggtcggagcctgcaaaccctgcagtgatcccaatctgtctgtggctgaaaaaggtcattactccctacactttgacgccttccaccaccctctgggtgatacccccccagccctccctgcccggaccctgcgcaagtctcctctccaccctatcccagcctcccccacaagcccccagtcaggtctggacggcagcaactctacgctgtccggcagtgccagcagcggcgtgtcctccttgagtgagagtaactttgggcactcctcggaggccccacctcgcactgacaccatggactccatgccaagtcaggcctggaatgctgacgaagatcttgagccaccctacctccctgtccactacagcctctctgagtctgccgtcctggactccatcaaggcccagccatgccgaagccactcagccccagggtgcgtcatccctcaggaccccatggacccgcctgcgctgccgcccaagccctaccacccccgcctgccggccctggagcacgatgagggggtgctgctgcgtgaagagactgagaggcctcgaggcctgcaccgcaaggctccattgcctcctgggagcgctaaggaggagcaggcccgcatggcctgggagcacggccgaggggagcagtgaggggcaacgaggcggctgggatgccgccctcagtaagcagcttgccaatcactccaggtctgaaaagcaagtcccccagccccaccccagggagccagagaggcttgcactcaggagagaaccacccccaagtctccgttctactgccgtgaactcatgtgttgccatgtacagaggccacagcagcatgaagggttgtggcttccctttttatttttttacatttccatttctatgggttttcctttctttcctttatgcagtagatgctttcttcctcctgcagttctggaccatgtggagctacatggagaaattgcacagacagaatcactttgccacactgcagggcccaggagtgggagcccaggccctccctccagggtagagatgcaccgaatggaaattgcactaaggacctcttcctttgctgtatggacagaagagttcatggttgcattcagggattgcaaggaccatatagacatgtcacaggtggaaaaagggccacaagccgttttgcacaaatgcctgcccacctgcccctcttccatccaggagtgtgctactgaggggctggctggaccaacctgctggctcaggcatgtgactggcctaactgcatgcccagggcactgccagggttcaatgggccagccgtctcctactccaccttggatttttctctccatcacatcatttctgaccatttgctcccttccattcttgaaacacctcatgccccacaggagccccagtggtgactggatctgcaagggttatctcccgccctctggggtttgagtggaggtatggagccagagaggctatcctagctaccttcctcctagggggagctggtccccttcctatgtggtagagagactggtgtaagagtgtggggtgtggcaggcgccggaaatcctcaaagctttcagaagcatccagaatgcctaccatcagctcctgaatcagggattttcagcactacctctgagccatggggttggctgcccagccaggcttccaggccctgaggacatgtggtcaggttcagcaggctcctgggtaaagagggtgggagggggcttctccttttggaagcagatagccatgcaggtagaattgtcatctcccaagtggccacatacagcaacccactccaggccatggggaccaccactcagggttcggggctggcaggagggtagtttctccagtctccccagtctgttggtgtctttataggaaactataaagcagagcagtggtgtctttagaggaaactcattcaagtcagggcactgattttcctctcagtttattatttggggggatagggtcaggtgggtatagtagtactttaccagggtgcttttaagttactttaaaaaaagcctacaaaatattttttttcttttatttgctcgagttcacattaatgatggtcacaaggctgccttgttgggcaggcgtattgcccccagttcctcttctgctggcctgtatgacctccacagccaggccctgggcccaagccccttgtcccttctccactgcccctctttccagacagtaaaggccatggtcagtgtgtttttctcttgtaaacaaaccccagcttgtttaacagaaatgctaataacctactgggaaagatggaggtctaaattacctccagggtttttctgggggtttatcaccagtgtgggtcccttctgataccaccaggttcactccaggcagagtggggcggaaggctgctgaggatatgggtcagttacagcagccctcacctcaaagggctggcctgcttctcagcctacattcatttgcaagcttcaatctctggaccatctggtgttcacaggtgttagagggttaggggttaggggctagttttggatttgattcataggtaggagggcttagattttaaggcacttctgaaagtcaatccctggacaaggcagtcatcacataagaacagctaccttctccacttggtggcacaagaggtagggaggggagtatgggttcatttggcttcgcattatgcaaggtgaaaccgtttgttttccctctccattttccctaactaaatgaaaaggacacattctgaaatcccttttgttggagaataagtcagtctgaggggaaatgggaggccagagatgagaaccctttgaaaagattgtaaaatactgattttcattctttcaagcttatttgtaaatacctatttgaatgctgtgtatttgtacaggaatttgagcaaaaaatgtatagagtgtgatgtccaattggtattcagcactataaatgtgtttttaacctcc

SEQ ID NO: 458706 - DNA, 7497 bp, Homo sapiens
cggtgacggggtagaaccaggtctgtggaactccctaagtgtcaaatggaattttcaagagatgaccctaatctttttccaattgttttatcaaggtgtctgtactaggataaggaattcctagtctctgttcctaaactttgttccaaatggttacgtggttgcagttctccgggaattgacctttagaaggaagacactaaaacatcagaatgtgcaacaacgagagtgagtggtcccagatccacgagaacatcatccgaaagtccagtgccaagtactctgcccccagcgccagccatggtcttatcatttctctgcagcttcttcgtggagacatggaacagattcggagagaaaatcccatgatatttaataggggattggcaattacaagaaaattgggatttcctgatgtcattatgccaggtgatatccgcaatgacctgtacctaaccctggagaagggggatttcgagagaggaggaaagagtgtacaaaagaatattgaagtgaccatgtatgtgctttatgcagatggagaaatcttgaaggattgcatcagcttgggttcaggagagccaaataggagttcctaccactcctttgtcctctaccacagtaatagtcctcgctggggagaaattatcaaattgcctatccccattgaccggttccggggctcccacctgcgctttgagttcagacattgttccacaaaggacaaaggggaaaagaaactctttggctttgcattctcaaccctgatgcgtgatgatggcaccaccctctcagatgatattcacgagctttatgtgtacaagtgtgatgagaatagcacgtttaataaccatgctctgtacctgggcctgccctgctgcaaagaggactacaatggctgccctaatattccttctagcctcatcttccagcgcagcaccaaagagtctttcttcatctccactcagctctcctctaccaaactcacccagaatgtggacctcctagctctgctgaagtggaaagccttccccgaccggatcatggatgtactagggcggctgcggcatgtcagtggggaggaaattgttaagtttctgcaggacatcttagatacactctttgtgattttggatgataatacagagaagtacggcctgttggtttttcagtctctggtgttcatcatcaacctgctccgagacatcaagtattttcactttcgacctgtgatggacacgtatatccagaagcactttgctggagctctggcatacaaggagctcatccgctgtttgaagtggtatatggactgctcagcagaactgattcgacaggaccacattcaagaagctatgcgggccttggagtaccttttcaagttcattgtacagtcacggatcctgtactcacgagccacttgtggaatggaagaggaacaattcagatccagtatccaagaacttttccagtccatccggtttgtgctcagtctggacagccgaaactcagaaacactcctttttactcaggctgcactcctcaattctttcccaaccatctttgatgagcttctgcaaatgttcaccgtgcaagaggtggcagagtttgtgagagggacactggggagcatgcccagcactgtgcacattgggcagtcaatggacgtggtcaagctgcagtccattgccaggacagtggatagccgcctgttttctttctcagggcgagtatgtgtcctgccttctctcactgctccgccagatgtgtgacacccatttccagcacctcctggacaacttccagagcaaagatgaactcaaggaatttctgctgaagattttttgcgtgttccggaacctgatgaagatgagtgtcttccctcgggactggatggtaatgagactgctcacaagcaatattatagtcactactgtccagtacctgtcctctgcactgcacaagaatttcacagagactgactttgactttaaggtgtggaattcttactttagcctggcagttctattcataaatcagccaagccttcagctagaaattatcacctcagccaaaaggaagaagattctagataagtatggggacatgcgtgtaatgatggcctatgaactgttcagcatgtggcagaatttgggtgaacataagatccactttattccgggaatgattggtccttttctgggtgtgacactggtcccacagccagaagtacggaatatcatgattcccatctttcatgacatgatggactgggagcagagaaaaaatggcaacttcaaacaggtggaggccgagttgattgacaagctggacagcatggtgtcagaagggaaaggtgacgagagctacagggagctcttcagcctactaacccagctgtttgggccctaccccagcctgctggagaaggttgaacaagaaacatggcgcgagaccggcatttcctttgtgacctcagtcacccgcctcatggaacgtcttcttgactacagggactgcatgaaaggagaggaaacagagaataagaagataggctgcactgttaacctgatgaatttttacaaatctgagattaacaaggaagaaatgtatatccgctacatccataagctttgtgacatgcacttgcaggccgaaaactacacagaggccgcatttaccctgctcctttactgtgagctgctgcagtgggaggaccggccactacgggaattcctccactacccatcgcagacagagtggcagcggaaggagggactgtgccggaagatcattcactacttcaacaaaggcaagagctgggagtttgggatcccactgtgcagggagctggcgtgtcagtacgagagcctctatgattaccagagcctcagctggattcggaaaatggaggccagctactatgacaacattatggagcagcaacgcctggagcctgagttctttcgggtcggcttctatggcaggaagtttcctttctttcttcggaacaaagaatacgtgtgccgtggccatgactacgagaggctggaggccttccagcagaggatgctcagtgagtttccgcaggctgtcgccatgcagcaccccaaccatcctgatgacgccatcctacagtgcgatgcccagtacttgcagatctatgcagtgacgcccattccagattatgtggatgttctgcagatggatagggtaccagatcgagtcaagagcttctatcgcgtcaacaatgtgaggaagttccggtatgacaggccttttcacaaaggccccaaggacaaggagaatgaattcaagagcctgtggattgaacgtaccacactgaccctgacccacagcttgcctggcatctctcggtggtttgaagtggagaggagggaactggtggaggtgagccctctggagaatgccatccaagtggttgagaataagaaccaggagctacgctccctgatcagccagtatcaacacaagcaggtgcatggcaacattaacctgctaagcatgtgcctgaatggtgtcattgatgcagctgtcaatggaggcattgcacgctatcaggaggccttctttgataaagattacatcaacaagcacccaggagatgctgagaagatcacccagctcaaggagcttatgcaggagcaggttcatgtccttggagttgggctagcagttcatgagaagtttgtgcacccagaaatgcggcctctgcataagaagctaattgatcagttccagatgatgcgggccagtctctaccatgagtttccaggtttggataagctaagtcctgcatgttcaggcaccagcaccccacggggaaatgttctggcatcccatagccccatgagtccggagagcatcaagatgacccaccggcacagtgaagcaggaaacatggtgatgctgggtgacggctccatgggtgatgctcctgaggacctgtaccaccacatgcagctcgcgtatcccaaccccaggtaccaaggctcagtcaccaacgtctctgttctgtcctcgtcccaggcaagcccttcttcctccagcctgagttccactcactcagcaccatcccagatgattacctctgccccttccagtgcccgaggctctccctctctgccagataagtaccgccatgcccgtgaaatgatgttgttgctgcccacataccgggaccgcccaagcagtgccatgtatccagcagccatcctggagaacggacagccgccgaatttccagcgagccctgttccagcaagtggtcggagcctgcaaaccctgcagtgatcccaatctgtctgtggctgaaaaagtctcctctccaccctatcccagcctcccccacaagcccccagtcaggtctggacggcagcaactctacgctgtccggcagtgccagcagcggcgtgtcctccttgagtgagagtaactttgggcactcctcggaggccccacctcgcactgacaccatggactccatgccaagtcaggcctggaatgctgacgaagatcttgagccaccctacctccctgtccactacagcctctctgagtctgccgtcctggactccatcaaggcccagccatgccgaagccactcagccccagggtgcgtcatccctcaggaccccatggacccgcctgcgctgccgcccaagccctaccacccccgcctgccggccctggagcacgatgagggggtgctgctgcgtgaagagactgagaggcctcgaggcctgcaccgcaaggctccattgcctcctgggagcgctaaggaggagcaggcccgcatggcctgggagcacggccgaggggagcagtgaggggcaacgaggcggctgggatgccgccctcagtaagcagcttgccaatcactccaggtctgaaaagcaagtcccccagccccaccccagggagccagagaggcttgcactcaggagagaaccacccccaagtctccgttctactgccgtgaactcatgtgttgccatgtacagaggccacagcagcatgaagggttgtggcttccctttttatttttttacatttccatttctatgggttttcctttctttcctttatgcagtagatgctttcttcctcctgcagttctggaccatgtggagctacatggagaaattgcacagacagaatcactttgccacactgcagggcccaggagtgggagcccaggccctccctccagggtagagatgcaccgaatggaaattgcactaaggacctcttcctttgctgtatggacagaagagttcatggttgcattcagggattgcaaggaccatatagacatgtcacaggtggaaaaagggccacaagccgttttgcacaaatgcctgcccacctgcccctcttccatccaggagtgtgctactgaggggctggctggaccaacctgctggctcaggcatgtgactggcctaactgcatgcccagggcactgccagggttcaatgggccagccgtctcctactccaccttggatttttctctccatcacatcatttctgaccatttgctcccttccattcttgaaacacctcatgccccacaggagccccagtggtgactggatctgcaagggttatctcccgccctctggggtttgagtggaggtatggagccagagaggctatcctagctaccttcctcctagggggagctggtccccttcctatgtggtagagagactggtgtaagagtgtggggtgtggcaggcgccggaaatcctcaaagctttcagaagcatccagaatgcctaccatcagctcctgaatcagggattttcagcactacctctgagccatggggttggctgcccagccaggcttccaggccctgaggacatgtggtcaggttcagcaggctcctgggtaaagagggtgggagggggcttctccttttggaagcagatagccatgcaggtagaattgtcatctcccaagtggccacatacagcaacccactccaggccatggggaccaccactcagggttcggggctggcaggagggtagtttctccagtctccccagtctgttggtgtctttataggaaactataaagcagagcagtggtgtctttagaggaaactcattcaagtcagggcactgattttcctctcagtttattatttggggggatagggtcaggtgggtatagtagtactttaccagggtgcttttaagttactttaaaaaaagcctacaaaatattttttttcttttatttgctcgagttcacattaatgatggtcacaaggctgccttgttgggcaggcgtattgcccccagttcctcttctgctggcctgtatgacctccacagccaggccctgggcccaagccccttgtcccttctccactgcccctctttccagacagtaaaggccatggtcagtgtgtttttctcttgtaaacaaaccccagcttgtttaacagaaatgctaataacctactgggaaagatggaggtctaaattacctccagggtttttctgggggtttatcaccagtgtgggtcccttctgataccaccaggttcactccaggcagagtggggcggaaggctgctgaggatatgggtcagttacagcagccctcacctcaaagggctggcctgcttctcagcctacattcatttgcaagcttcaatctctggaccatctggtgttcacaggtgttagagggttaggggttaggggctagttttggatttgattcataggtaggagggcttagattttaaggcacttctgaaagtcaatccctggacaaggcagtcatcacataagaacagctaccttctccacttggtggcacaagaggtagggaggggagtatgggttcatttggcttcgcattatgcaaggtgaaaccgtttgttttccctctccattttccctaactaaatgaaaaggacacattctgaaatcccttttgttggagaataagtcagtctgaggggaaatgggaggccagagatgagaaccctttgaaaagattgtaaaatactgattttcattctttcaagcttatttgtaaatacctatttgaatgctgtgtatttgtacaggaatttgagcaaaaaatgtatagagtgtgatgtccaattggtattcagcactataaatgtgtttttaacctcccgcattctgtgcttatttaaaacaaggaaacttctaaccatttcttttgtgtattcatgtttaaagaaaaaaagtgatttaaaaatgatcttacctgtaccagaaaagcaaagttaaaggaaacaaaatttgtaccattgtcccaagaggtattttactgtatatattgtggtagcatgttcaaaatccaacaagtaatgtgaattttagatgtaaatatctgccacttgattttttttccccctttccccacttccttgactgctgtgatgtgaattaaagataaatacgtgatactgatccactgaa

SEQ ID NO: 458707 - DNA, 337 bp, Homo sapiens
tacccagggctcccatagacctgccagtggttccacccacagcaggtgttccttctggctggtgctttctccttctggtgctgtctgcctccagggcctgccctccccctcctgcccagcacacccacggctatggccagctgcccagagcttggctatggcttccacaggtagttgacaggtgtttccttctctttattgtagaatttttacaaatctgagattaacaaggaagaaatgtatatccgctacatccataagctttgtgacatgcacttgcaggccgaaaactacacaggtaagtggggagaagagagagccatgcctgaccatgagg

SEQ ID NO: 458708 - DNA, 651 bp, Homo sapiens
gcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaa

SEQ ID NO: 458709 - DNA, 504 bp, Homo sapiens
aaatggagtctcactctgttgtccaaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatgtttacttata

SEQ ID NO: 458710 - DNA, 797 bp, Homo sapiens
gcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaaaaaaaaaaaacgcactttatgaatcttaatataagactttattcaaaacagtggggggccgccggcccccctctttttttcctgagaaatttttcattcgcccccatttgggcccttctggccaattccgccttgggggggtttt

SEQ ID NO: 458711 - DNA, 2032 bp, Homo sapiens
gcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagagggtatcttcccccttttttccttttaaactcttgagcctcctataacgaaggattatgtgtttcaaacctattttttttttactgtttcattaagtgtgcttgtgcccaaaatatttacttgtataatatctgtaacttgcttaaatacttcagcaaagtcagcatatttactcattcaacaaatatttgagccaggcattattttagacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaatacaaaaaaatacaaaaaaattagctgggcatgttggcatgcacctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatgtttacttata

SEQ ID NO: 458712 - DNA, 2030 bp, Homo sapiens
gcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaacctattttttttttactgtttcattaagtgtgcttgtgcccaaaatatttacttgtataatatctgtaacttgcttaaatacttcaacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaatacaaaaaaatacaaaaaaattagctgggcatgttggcatgcacctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatgtttacttata

SEQ ID NO: 458713 - DNA, 2032 bp, Homo sapiens
gcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaacctattttttttttactgtttcattaagtgtgcttgtgcccaaaatatttacttgtataatatctgtaacttgcttaaatacttcagcaaagtcagcatatttactcattcaacaaatatttgagccaggcattattttagacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaatacaaaaaaatacaaaaaaattagctgggcatgttggcatgcacctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttaggtctacctgggccagggtagaccgtaacattggacttatggtcttagcactggacactggttttagggcttttcactagggcacattccgaagggtaccaacaatgttaatatacatcactctactctccactatatagatgctatgtctaagaaaaa

SEQ ID NO: 458714 - DNA, 2076 bp, Homo sapiens
gcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaacctattttttttttactgtttcattaagtgtgcttgtgcccaaaatatttacttgtataatatctgtaacttgcttaaatacttcagcaaagtcagcatatttactcattcaacaaatatttgagccaggcattattttagacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaatacaaaaaaatacaaaaaaattagctgggcatgttggcatgcacctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttaggtctaccccaggtagacctaacactgcattctcactataacatgccctataatggctgcatcccttttgagcacctccaaaatctacatttacacagtaggtaaattagggatgactgcattatcaaaatactctcagggttcctataaatggcagctctcctgttgtattcaggtgttgttacgactacatatgtgttgca

SEQ ID NO: 458715 - DNA, 2031 bp, Homo sapiens
gcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgtcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaacctattttttttttactgtttcattaagtgtgcttgtgcccaaaatatttacttgtataatatctgtaacttgcttaaatacttcagcaaagtcagcatatttactcattcaacaaatatttgagccaggcattattttagacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaatacaaaaaaatacaaaaaaattagctgggcatgttggcatgcacctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatgtttacttata

SEQ ID NO: 458716 - DNA, 1787 bp, Homo sapiens
caacactctctgtgacttgctttcatctttgatgtgtggttctcttgtgtattttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaacctattttttttttactgtttcattaagtgtgcttgtgcccaaaatatttacttgtataatatctgtaacttgcttaaatacttcagcaaagtcagcatatttactcattcaacaaatatttgagccaggcattattttagacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaatacaaaaaaatacaaaaaaattagctgggcatgttggcatgcacctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatgtttacttata

SEQ ID NO: 458717 - DNA, 981 bp, Homo sapiens
gcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatgtttacttata

SEQ ID NO: 458718 - DNA, 2085 bp, Homo sapiens
gcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaacctattttttttttactgtttcattaagtgtgcttgtgcccaaaatatttacttgtataatatctgtaacttgcttaaatacttcagcaaagtcagcatatttactcattcaacaaatatttgagccaggcattattttagacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaatacaaaaaaatacaaaaaaattagctgggcatgttggcatgcacctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatgtttacttata

SEQ ID NO: 458719 - DNA, 2115 bp, Homo sapiens
gcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaacctattttttttttactgtttcattaagtgtgcttgtgcccaaaatatttacttgtataatatctgtaacttgcttaaatacttcagcaaagtcagcatatttactcattcaacaaatatttgagccaggcattattttagacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaatacaaaaaaatacaaaaaaattagctgggcatgttggcatgcacctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatgtttacttataaaaaaaaaagaagaaattctctcagggctg

SEQ ID NO: 458720 - DNA, 2037 bp, Homo sapiens
gcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaacctattttttttttactgtttcattaagtgtgcttgtgcccaaaatatttacttgtataatatctgtaacttgcttaaatacttcagcaaagtcagcatatttactcattcaacaaatatttgagccaggcattattttagacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaatacaaaaaaatacaaaaaaattagctgggcatgttggcatgcacctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttaggtctacctggggcaaaaagccggttagcgggggcaggcctcctagggagaggagggtggatggaattaagggtgttagtcatgttagcttgtttcaggtgcgagatagtagtagggtcgtggtgctggagtttaagtgagtagtaggatgcgtagtagttagt

SEQ ID NO: 458721 - DNA, 1928 bp, Homo sapiens
tcgctctacgaggatccccggaatacaccgcgcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggctgaatataaaagcatttgtacttaaaggtcttgtgtattcattaagaaatatagtaatgtcttttaatgttttaagagttgatcagggtttactatgatgcaagtaataggatgattaataagggaaggtttttatgaattcaaaagtcaattattcaaaagcagggaaagattttgagagagggaacaaagtattcttagattgcgtagaagctgctaggttccagttttaatttttaggtttagttggactctgttatgaaaagataggttatgggtgggcgacaggttgatacagtcttagaaaaagcaggtaatatcaaagtattggaaagctagcatgcatgccctcttacctgggtatcttcccccttttttccttttaaactcttgagcctcctataacgaaggattatgtgtttcaaacctattttttttttactgtttcattaagtgtgcttgtgcccaaaatatttacttgtataatatctgtaacttgcttaaatacttcagcaaagtcagcatatttactcattcaacaaatatttgagccaggcattattttagacacagcagtgaacaaaacaaaaaggcattcttgccttcatggagcttacattcttattgttatttaaatctaaatgttataaaacaagaatttatattctagggttgatcagctagtatttaatcaaaaaggccacactcccatagcagctactctaagctgtagtagctaataaaaaatattaatgttggccgggcacagtggctcacgcctataatcccagcactttgggaggccaagggtggtagatcacttgaggtcaagagttgtgacaccagcctggccaacctggtgaaaccctatctctattaaaaaatacaaaaaaatacaaaaaaattagctgggcatgttggcatgcacctgtagtcccagctatttgggaggctgaggcacgagaattgcttgaatccgggaggtggaggttgcagtgagccaagatggggccactgcactctaacgtgggcaacagagaccctgtctcaaaaagaaaatattcctgttagccctaaaggctttacatgaggaatggtagaagtggtcttttgtttaaattagttgcattcagcatatatgaattgtcttaaatattttggggatactcccccgccttttaaacagggcataagatctggtaaactctctgtatatcttcctacctttcaaaatcgttcttagggttagtcaagtctggaatataattgctgactataaagttagcaattatgcttttaaggtgttgtcacatcaacctaaagagaaccatctatggaaggtatggttgaaacatctgtaggaacacagaactgggatttcactgagtttaccaaatcaactgtgtgaactgtttctgcactgcttgctaatggtttcatctaataaatgtttacttata

SEQ ID NO: 458722 - DNA, 742 bp, Homo sapiens
gcgctgggaagagtaggttcagagtgcattccggaacccggggcgcggcgcactgcgcaggcggccggactccgctcagtttccggtgcggcgaacaccaaagtccgggaacttaagcattttcggtttctagggttgttacgaagctgcaggagcgagatggaggtggacgcaccgggtgttgatggtcgagatggtctccgggagcggcgaggctttagcgagggagggaggcagaacttcgatgtgaggcctcagtctggggcaaatgggcttcccaaacactcctactggttggacctctggcttttcatccttttcgatgtggtggtgtttctctttgtgtattttttgccatgacttgttcgctgatatctaaattaagaagttggttcttgagtgaattctgaaaatggctacaaacttcttgaataaagaagacaggactctcaatagaagaatttcacatctccaagggacccttcctttcattttacactttgttactaatttgcagaactctattaattgggtaggatttcacccattcctagctaagttcttaaaattaaaccctttggttcgtgtttaaaaactttcaaacatctgatggctttacaggggtccagtcttccgggggtttctagggttgttacgaagctgtgggacgagatgaggtgggtgaggtgggtggggaggctgatgcgttatagccagtggtgttttttgagtgagagggggt

SEQ ID NO: 458723 - DNA, 970 bp, Homo sapiens
ccgcgcccccatccccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggttggacaagctgcatactctgcttccaaggggggaatagtgggcatgacactgcccattgctcgggatctggctcccataggtatccgggtgatgaccattgccccaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcaca

SEQ ID NO: 458724 - DNA, 943 bp, Homo sapiens
ccgcgcccccatccccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggttggacaagctgcatactctgcttccaaggggggaatagtgggcatgacactgcccattgctcgggatctggctcccataggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcaca

SEQ ID NO: 458725 - DNA, 1010 bp, Homo sapiens
  misc_feature (993)..(993): n is a, c, g, or t
  misc_feature (996)..(996): n is a, c, g, or t
ccgcgcccccatccccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggttggacaagctgcatactctgcttccaaggggggaatagtgggcatgacactgcccattgctcgggatctggctcccataggtatccgggtgatgaccattgccccaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcacaaaaaaaaaaaaaaaaaaaaaaanaanaaaaaaaaaaaaaa

SEQ ID NO: 458726 - DNA, 936 bp, Homo sapiens
ccgcgcccccatccccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggcccacctaagcagcagcagccttttatctttgggccccagagaagcaccaagaagtagggctaaagtaaggaagaaccaggtaatcatgaaagcaagggtgagtctctgaatttggctatattgtttgtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcaca

SEQ ID NO: 458727 - DNA, 811 bp, Homo sapiens
ccgcgcccccatccccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccgtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcaca

SEQ ID NO: 458728 - DNA, 650 bp, Homo sapiens
ccgcgcccccatccccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcagacacgctcctctgcccttcctttccctggggtactactctccagcttgggaggaagcccagtagccattttgtaactgcctaccagtcgccctctgtgcctaataaagtctctttttctcaca

SEQ ID NO: 458729 - DNA, 532 bp, Homo sapiens
ccgcgcccccatccccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcaca

SEQ ID NO: 458730 - DNA, 471 bp, Homo sapiens
acctttctcttggcctctcccttctcacaaatctcttctcacccaaggactgggcatgccctgccctgccctccctcaggtttagtgggaagagtgggtgctgggagatgaataccttctccacttctctctttgaaggtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtaaggccttggaagttctccagggatagtggtagtaagaagtatctggctgtggaggaccccaaagtttttaggggacaaaggcttcttctgcctcaggtcctatagcatgtctccatctgtcctacaggtgaatctcatgggcaccttcaatgtgatccgcctggt

SEQ ID NO: 458731 - DNA, 1008 bp, Homo sapiens
ccgcgcccccatccccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggttggacaagctgcatactctgcttccaaggggggaatagtgggcatgacactgcccattgctcgggatctggctcccataggtatccgggtgatgaccattgccccaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcacaaaaaaaaaaaaaccgagggactaacgggggcgaaaagc

SEQ ID NO: 458732 - DNA, 532 bp, Homo sapiens
  misc_feature (470)..(470): n is a, c, g, or t
ccgcgcccccatccccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaaatcttccatggggccacctttccaatggtgaatccccgcctgggtgggctgggtgaagatggggccncaaaaatggaacccagtacccagggtaggggcccaacggtgggggttcattcattcaaacac

SEQ ID NO: 458733 - DNA, 1111 bp, Homo sapiens
ccgcgcccccatccccatcccgtggagtggccggcgacaagatggcagcagcgtgtcggagcgtgaaggtagaaggttctttgcctctgttgcttgccttcctttacgggccgggacagcgcggccgtggaactaggagaaagagatcggtttcgagggaaagggtcatgcttatgtaggcctggtattgtggccgttgggctcaagagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggttggacaagctgcatactctgcttccaaggggggaatagtgggcatgacactgcccattgctcgggatctggctcccataggtatccgggtgatgaccattgccccaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcaca

SEQ ID NO: 458734 - DNA, 1171 bp, Homo sapiens
ccgcgcccccatccccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggttggacaagctgcatactctgcttccaaggggggaatagtgggcatgacactgcccattgctcgggatctggctcccataggtatccgggtgatgaccattgccccaggtagacatatcccctctctccatcatacctgggattgggtgggatccatggacagttgagaggggaaggtatccaccacctaagcagcagcagccttttatctttgggccccagagaagcaccaagaagtagggctaaagtaaggaagaaccaggtaatcatgaaagcaagggtgagtctctgaatttggctatattgtttgtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcaca

SEQ ID NO: 458735 - DNA, 1067 bp, Homo sapiens
ccgcgcccccatccccatcccgtggagtggccggcgacaagatggcagcagcgtgtcggagcgtgaagggcctggtggcggtaataaccggaggagcctcgggcctgggcctggccacggcggagcgacttgtggggcagggagcctctgctgtgcttctggacctgcccaactcgggtggggaggcccaagccaagaagttaggaaacaactgcgttttcgccccagccgacgtgacctctgagaaggatgtgcaaacagctctggctctagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccaacgtggggtcatcatcaacactgccagtgtggctgccttcgagggtcaggtctgtttggcaccccactgctgaccagcctcccagagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcacaaaaaaacaccacacacagcaaaacaaacactccggggcaacaaaatgccggcggcgcgcaaacagagacggcacgggacagcgcgccctggccacaaagcaggacccatgaccaaagttcctgctccccacggcggccaactcgcccgggcccccaaataggagaagccgcaatatagttcgaaaacccggggttaaccgcagaag

SEQ ID NO: 458736 - DNA, 597 bp, Homo sapiens
  misc_feature (580)..(580): n is a, c, g, or t
  misc_feature (583)..(583): n is a, c, g, or t
gggatctggctcccataggtatccgggtgatgaccattgccccaggtctgtttagcaaaaggaaagtttggccgtgtggatgtagctgtcaactgtgcaggcatcgcggtggctagcaagacgtacaacttaaagaagggccagacccataccttggaagacttccagcgagttcttgatgtgaatctcatgggcaccttcaatgtgatccgcctggtggctggtgagatgggccagaatgaaccagaccagggaggccagaaagtgtgcaacttcttggccagccaagtgcccttccctagccgactgggtgaccctgctgagtatgctcacctcgtacaggccatcatcgagaacccattcctcaatggagaggtcatccggctggatggggccattcgtatgcagccttgaagggagaaggcagagaaaacacacgctcctctgcccttcctttccctggggtactactctccagcttgggaggaagcccagtagccattttgtaactgcctaccagtcgccctctgtgcctaataaagtctctttttctcacaaaaaaaaaaaaaaaaaaaaaaanaanaaaaaaaaaaaaaa

SEQ ID NO: 458737 - DNA, 215 bp, Homo sapiens
agtttgctggaagtggatcatatgtttaagagtgaacagatgttaagacgactctgctttgttaaaaacttctgttttgcagtgagcagaaacaggttgggctaaaagactgaacatgaaataagcttcacaaagaatttaatgactgttgaagaagaagagagtacaaacaaataggagagaggagaggccagtgaaagatcactgtggaaagg

SEQ ID NO: 458738 - DNA, 1495 bp, Homo sapiens
  misc_feature (1470)..(1470): n is a, c, g, or t
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaatggaacaggacctcagagatgacaggacaaggcacagtcagagagtagcagacaaaaaaataaagcagagactgtcccagagacangccaacctcgtgtaaaagagcggag

SEQ ID NO: 458739 - DNA, 1746 bp, Homo sapiens
gtcttgctttgtcacccagggtagagtgcagtggcgcgatctgggctcacagcagcttccacctcctgggttcaagtgattctcctgccgcagcctcccaaatagctaggattacaggcacctgccaccacacctggctagtttttgtatttttagaagagacagggtttcaccatgttggccaggctggtgtcaaactcctgacctcaggtgacaggtctgcctcagcctcccaaagtgctggaattatgagcatgagccactgtgcctggccaatacatacgtacatttaaatactagcaacctaatcagttattagctgactttgtataggtatataatctctttggtactcagtttccatccgtgaaatgagaataataaacttacgttgaagggttgctatgagaattaaatgagaggatatcagtaaagagcttctgcctctacagttgtaactggttattactggaaagtttagacttctctgagtcccttgaggctatttgcttgaaaacaagcttctaagtatagacagtgatgaaccactgggggcagtgcttctttttccagaaagtacataagtagatataaaatttgtagcaaaaattcatagccctgttttgtttcctaggatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaaggtaatgatgcccttctgttcatgcagatatccacagcctttgcaattcgccatttggatttagaagtagaatgagatttgagggccctggaataattgtctttttatgggtatgttcaagaaggatgggtggggccgttgatgggatacctgcacctgtccttgcagagagaggggaacctgcaagtttggggtgttctttaaaaaagaaggcctttacttggtcttttatgacatatttcagggggaaatgtttgaatgagataggacaggtgagagaaatcggcatttacatgtaaatacgaaatacgttctcagattcatattagaggagcacaatccacaactgaatttgaatacttgaagagtttgagtcaaaaacaaatattagcaagagttattggaatataaatggatgaaaagccttgctattataacctttacattaggggttttatgaagttcattctaaaccaaagaatttggtacagtgttgcagtgtatacttgctgacctctgaacacagtaaaatcattgccaaaacacaaacaactgctgtaattctaatatccagttgataactctaatagatttcttgataagtgcctttgaaacttttactttgaaattttatattaaatataaaataaacttctatttaagaacaaatataaaaatcagattaggctgtttgggtagtttttcctcctcacttagcagtatatcacaactttccaagtgattaaatgttaaagtcatttttacagccttggcaacgtagggagacctcgtctctacaaaataaaaacaagcaaaaatctagctgggcattgcggcatgtgcctacgggcccagttgcatgggaggcagaggtgagaggattgcttaggcccaggagctcgaggctgcagtgagccatggttgtgtcacacttcactccagcttgggcaacagaggaagaccttgtctcaa

SEQ ID NO: 458740 - DNA, 625 bp, Homo sapiens
ccatcatatttacccattttaataacacaacataggtaagaaacctaaatcgcacggtaggattgcacaaatgacaatgactccttgtaactcttttttaaaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggtaaccactttggcctcgtctgcccagtttgatttgactgagtgtgggagtggattctgttttcttttaataaaaggtggcatagccacctaagaaatctttctcccagcacaactcatctattggcaatatacctgcaggctttaactccctttccatgaaataggccattccactgagaccagccttttgaaggggtaggacgat

SEQ ID NO: 458741 - DNA, 474 bp, Homo sapiens
gcctactactactaaattcgcggccgcgtcgatgctttaaagagtcatcatgttgtttggttatgcttttgagtgtcttgatttgtattttaatcatcattttctctccttttccaggccaaattaaagaagcggaagcctcgggtaaagaaggaaaacaaagtgcccaggctgaaagaggagcatggaattgagctttcatctcctaggcattcagataatccatcagaagagggagaagtgaaagtatgaagtggggtttcggttgagggttatttatttattttagctatacttatcatgccagctggaataaaatcatctgaaatgtgtttggtttacgagtggattaaatggaaatagaatatgtaagtcttcgcttaatctgtcagcgaggatagtttaagtcagcaactgcaaatttgtacataatggaagtaaatgaaggggactatgacatttttgttgttgttg

SEQ ID NO: 458742 - DNA, 417 bp, Homo sapiens
ccctctgcctttggtctgaaagactgggatgatgatgagatccaagcttcggtgctggcagtgtcccaacaggaaaacctagacagtatgaagaagaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaactgcctcgttccccaccactgctaaagtgcgg

SEQ ID NO: 458743 - DNA, 292 bp, Homo sapiens
taacaataagccagagatatattcagagagactaagaggtcagggttcgttgatacatgttttctgtggaacttctgcagattttcatttaactaatgtgaaactggtatttttcaggaaaaggaccagggaaaaggagaggtccaacaatcaagatatccggagttcaggttaatgtgaaatccattatccaacatgaagaggagtttgagatgctgcataaatctatccctgtgccccacaagcgggggccgggcttggtgtcgtttgggaatgaccgtgttccctgcgt

SEQ ID NO: 458744 - DNA, 8903 bp, Homo sapiens
  misc_feature (8384)..(8387): n is a, c, g, or t
  misc_feature (8461)..(8461): n is a, c, g, or t
  misc_feature (8468)..(8468): n is a, c, g, or t
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttctgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccaaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttggcgcacagttccgcaggctgtacaagcatagcaccagcatctggttggcttctggagaggcctcagggagcttttactcatggtggaaggtgaagtggcagtaggcgtcccatggcaagagagggagcaagagagagaggaggaggtgccagcctcttttaaagcaccagctctcacgtgaactcagagaactcactcattatcacaaggacagcaccaagccatttatgagggatctgcccaaacacctcccactacannnnggaagagcccgagcgtggctttatcttgcactcatgcaaaagaaactggcagattatctgaaagtgcctatagncaataancatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagaga

SEQ ID NO: 458745 - DNA, 6317 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaaggtaatgatgcccttctgttcatgcagatatccacagcctttgcaattcgccatttggatttagaagtagaatgagatttgagggccctggaataattgtctttttatgggtatgttcaagaaggatgggtggggccgttgatgggatacctgcacctgtccttgcagagagaggggaacctgcaagtttggggtgttctttaaaaaagaaggcctttacttggtcttttatgacatatttcagggggaaatgtttgaatgagataggacaggtgagagaaatcggcatttacatgtaaatacgaaatacgttctcagattcatattagaggagcacaatccacaactgaatttgaatacttgaagagtttgagtcaaaaacaaatattagcaagagttattggaatataaatggatgaaaagccttgctattataacctttacattaggggttttatgaagttcattctaaaccaaagaatttggtacagtgttgcagtgtatacttgctgacctctgaacacagtaaaatcattgccaaaacacaaacaactgctgtaattctaatatccagttgataactctaatagatttcttgataagtgcctttgaaacttttactttgaaattttatattaaatataaaataaacttctatttaagaacaaatataaaaatcagattaggctgtttgggtagtttttcctcctcacttagcagtatatcacaactttccaagtgattaaatgttaaagtcatttttacagccttggcaacgtagggagacctcgtctctacaaaataaaaacaagcaaaaatctagctgggcattgcggcatgtgcctacgggcccagttgcatgggaggcagaggtgagaggattgcttaggcccaggagctcgaggctgcagtgagccatggttgtgtcacacttcactccagcttgggcaacagaggaagaccttgtctcaa

SEQ ID NO: 458746 - DNA, 5953 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggtaaagtacaaattcagtcctaattcatacaaacaaataccaattccacagaaaaatctcttaatttttgtttttccatggggagatgatcacagaatcatgggttattgctggtgctaatagtcaaacaataagaccagatgggtgaaatagccaatgtattggagcctaacatggttgaaattctgacaaa

SEQ ID NO: 458747 - DNA, 9245 bp, Homo sapiens
  misc_feature (8726)..(8729): n is a, c, g, or t
  misc_feature (8803)..(8803): n is a, c, g, or t
  misc_feature (8810)..(8810): n is a, c, g, or t
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcaggtaagttcacgatcattggtgataattttaaagatttatttgtttaagtttgccttgttttctgtaaatacgagaaattcttggatgacgcaataagatacagagattgttatttgtatctagtgtgctactttgagaaagtttccttattgatagtgatgcttccactgttcggtttatcctggtgttttttcttttaaggaaaaaatagaaatatttagttttttggtgcttaccgttgttgtgttataacaatatcgttaacatcgtcaggactttgttcctgataataaaaagcatcgatagaagccgggaccttacctttctttcaacttttgacagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttctgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccaaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttggcgcacagttccgcaggctgtacaagcatagcaccagcatctggttggcttctggagaggcctcagggagcttttactcatggtggaaggtgaagtggcagtaggcgtcccatggcaagagagggagcaagagagagaggaggaggtgccagcctcttttaaagcaccagctctcacgtgaactcagagaactcactcattatcacaaggacagcaccaagccatttatgagggatctgcccaaacacctcccactacannnnggaagagcccgagcgtggctttatcttgcactcatgcaaaagaaactggcagattatctgaaagtgcctatagncaataancatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagaga

SEQ ID NO: 458748 - DNA, 5458 bp, Homo sapiens
  misc_feature (5360)..(5360): n is a, c, g, or t
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaaggaaaaggaccaggnaaaaggagaggtccaacaatcaagatatccggagttcaggttaatgtgaaatccattatccaacatgaagaggagtttgagatgctgcataaatctat

SEQ ID NO: 458749 - DNA, 5335 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggaaggagggaaggaaggagggaaggaaggagggaaggaaggagggaaggaaggagggaaggaaggagggtaag

SEQ ID NO: 458750 - DNA, 8770 bp, Homo sapiens
  misc_feature (8251)..(8254): n is a, c, g, or t
  misc_feature (8328)..(8328): n is a, c, g, or t
  misc_feature (8335)..(8335): n is a, c, g, or t
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttctgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccaaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttggcgcacagttccgcaggctgtacaagcatagcaccagcatctggttggcttctggagaggcctcagggagcttttactcatggtggaaggtgaagtggcagtaggcgtcccatggcaagagagggagcaagagagagaggaggaggtgccagcctcttttaaagcaccagctctcacgtgaactcagagaactcactcattatcacaaggacagcaccaagccatttatgagggatctgcccaaacacctcccactacannnnggaagagcccgagcgtggctttatcttgcactcatgcaaaagaaactggcagattatctgaaagtgcctatagncaataancatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagaga

SEQ ID NO: 458751 - DNA, 4895 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagaagttgattgttgatgcatgaaaagctttttagg

SEQ ID NO: 458752 - DNA, 5433 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagtatgaagtggggtttcggttgagggttatttatttattttagctatacttatcatgccagctggaataaaatcatctgaaatgtgtttggtttacgagtggattaaatggaaatagaatatgtaagtcttcgcttaatctgtcagcgaggatagtttaagtcagcaactgcaaatttgtacataatggaagtaaatgaaggggactatgacatttttgttgttgttg

SEQ ID NO: 458753 - DNA, 3220 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaagtaggtagaaaaatatgagtgcaattttccttactgtttctggcttctttattgttagatgtcaagaattttttttttcttttttcacacccttattgtatctcaaccaagaaatctttatgctgcatattacagaaataaaagatgattgagagaaatgcttcctgggagtttttatgtatgtgtaataccattttattctgatctaaagaatactttatttcattatttggtgggtaatttgtcatagccagaaacctgtatcatcatatgttactcatgagtgtatatagcaagttaagtcactcaaatctttaatgtggaaggagttactcagaagaaagaagaagatgtctttttcacatgtattttctttctaggccagggaagcctttaaattaatttcctacagtagtgctgtagagagtgtgattcccctcccttcactccactccctacctatatagtctgtaggattatcctgttcagaggaaggttgaacctgtgaaagtatcctttttataagaccacgttaatcttgggggggtgaaaaaaagatgagacagtgatagcactggaggtttaaaggtacttttgggaagtacttacaaatttccttcaccaatttcaagtagttcctaattactaag

SEQ ID NO: 458754 - DNA, 2760 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaccacacacacctagagaacttcacgcacacacacgaggacgcacctcaaaccaatggttcagggacaagtttctccctgaagactgtagaactatgtacaacttggccgaaccagcgacgctcgggtttcacagacgttcgacacttaaaccacggatcccccatacgctagcacacgaacgtaactagtcgtgacacacacacatccaaccctacactagaggtcacacccagatactccagctcccatactcccgaacccggcacactcaacaataagccgaccaatactacagtccactatggcatgcgtacacccataatacaaaaatcgcatccttgcgacaacaacacacacaccaactggcactaaaaatatctaccacactgaccctcgtaaccaactcccaacatcaaggagacaactcaaaaactcatactcaacactaactaaacacacaccacatattactatcaaacgccacaacacggcgacatcacacataacactcacaaatacaaacaagataaatagacaaatatccacacacactcaacaaaccatcactaaccttacacatacagcaaaatcaataaccacttaacaaaacacataaccacccaaccaccaaccacaaccgacatacacacatcaccctctaacacctctactaccacaaacacga

SEQ ID NO: 458755 - DNA, 2612 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtgagctatcaactttcttcctttttgtctttttttttgggggagaaacctcagcttacaattgtttaccttgacagacatggattgctgtctgttttattgtgtttttctaatttggattcgttttttaaagcatgaccttgagattgctaatatgccacaccctaattttttggtagcaatttatgaaagttgagttgtgacttaaggcctcttacagcagtcaaaaggtaaggtacctttattcaaaggggcctttactgtaatgtacagtttttctgtcagtaaatttcagtttttaggtttttgtactgcagaaaaatgaccttgtcggtttagccattgctgcattgcaccattttacatacaaggcaaattttttctttgaagaatccaggatatctaaacttgtaactgagggccatagagaagccttgtagtagtaaattatagtaaatagacatatcagaaagttatatgaatgaaaaaatgtacatttaaaaacaaaatcacttaaaggaccctttgactgatgcctctcagtttatatttttatgtgactttatatttcttttgatacacttgacattttaggaaattttgatgtgatttatcaaaacctttacttgatggttagagttcctgcatttatgaaatcaaatctgtaataacagaaatcctggaatactcttaatatatacttctattttgtgtttgttactgtgattaatatttgcagttgtatattttacatttaaattattttaaggtttgcatttgtatgcttaagacattgatttcctgttggtagatgtattttatcctcacaatttagatgtagctgctttaaatttattgatgtatttcgacagagtcgtctggaatgctttatcttctgaagcttaaaaatgtactgtttgtgcaaatcatgatctgtttcacattccttggagtaccttgttagtgatgaagtaataaagcctctaagatgtttttgttgtatgacctctgtatattaatttttaaaagtacatatgaatgcattttttgatgtgttctttatgcattttcatattataaattttaaatcatgcagtttaacaaggatgtgattcattatgtggttttccttcccaatttttacttttctaatttttataaataatacacttttctattaggctagtgaatttgaaagttttgaacatgatgtgttactaatatgctgaattctatttattttatttgactgaaagcatattgagccttgctttagaaaataagttaccaaatttttttgcattgagttgtcacccagtttgtagtgctgtcttaattgaattgcccatgtaaattactagattaaattgaggacagaaaagttttttactcatcctaagctgtttttttctggaaagtaatgacaatttgaagaaatgagaacctccagatatatttggcaaattattaaagattcagcact

SEQ ID NO: 458756 - DNA, 2123 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtgagctatcaactttcttcctttttgtctttttttttgggggagaaacctcagcttacaattgtttaccttgacagacatggattgctgtctgttttattgtgtttttctaatttggattcgttttttaaagcatgaccttgagattgctaatatgccacaccctaattttttggtagcaatttatgaaagttgagttgtgacttaaggcctcttacagcagtcaaaaggtaaggtacctttattcaaaggggcctttactgtaatgtacagtttttctgtcagtaaatttcagtttttaggtttttgtactgcagaaaaatgaccttgtcggtttagccattgctgcattgcaccattttacatacaaggcaaattttttctttgaagaatccaggatatctaaacttgtaactgagggccatagagaagccttgtagtagtaaattatagtaaatagacatatcagaaagttatatgaatgaaaaaatgtacatttaaaaacaaaatcacttaaaggaccctttgactgatgcctctcagtttatatttttatgtgactttatatttcttttgatacacttgacattttaggaaattttgatgtgatttatcaaaacctttacttgatggttagagttcctgcatttatgaaatcaaatctgtaataacagaaatcctggaatactcttaatatatacttctattttgtgtttgttactgtgattaatatttgcagttgtatattttacatttaaattattttaaggtttgcatttgtatgcttaagacattgatttcctgttggtagatgtattttatcctcacaatttagatgtagctgctttaaatttattgatgtatttcgacagagtcgtctggaatgctttatcttctgaagcttaaaaatgtactgtttgtgcaaatcatgatctgtttcacattccttggagtaccttgttagtgatgaagtaataaagcctctaagatgttt

SEQ ID NO: 458757 - DNA, 2910 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcaggtaagttcacgatcattggtgataattttaaagatttatttgtttaagtttgccttgttttctgtaaatacgagaaattcttggatgacgcaataagatacagagattgttatttgtatctagtgtgctactttgagaaagtttccttattgatagtgatgcttccactgttcggtttatcctggtgttttttcttttaaggaaaaaatagaaatatttagttttttggtgcttaccgttgttgtgttataacaatatcgttaacatcgtcaggactttgttcctgataataaaaagcatcgatagaagccgggaccttacctttctttcaacttttgacagtaaatacctgggcacaggacttcaaagcaaacacagattccccctcccccttaatatttaagaattaaaagatgatgagaaataaggactgagctatcaactttcttcctttttgtctttttttttgggggagaaacctcagcttacaattgtttaccttgacagacatggattgctgtctgttttattgtgtttttctaatttggattcgttttttaaagcatgaccttgagattgctaatatgccacaccctaattttttggtagcaatttatgaaagttgagttgtgacttaaggcctcttacagcagtcaaaaggtaaggtacctttattcaaaggggcctttactgtaatgtacagtttttctgtcagtaaatttcagtttttaggtttttgtactgcagaaaaatgaccttgtcggtttagccattgctgcattgcaccattttacatacaaggcaaattttttctttgaagaatccaggatatctaaacttgtaactgagggccatagagaagccttgtagtagtaaattatagtaaatagacatatcagaaagttatatgaatgaaaaaatgtacatttaaaaacaaaatcacttaaaggaccctttgactgatgcctctcagtttatatttttatgtgactttatatttcttttgatacacttgacattttaggaaattttgatgtgatttatcaaaacctttacttgatggttagagttcctgcatttatgaaatcaaatctgtaataacagaaatcctggaatactcttaatatatacttctattttgtgtttgttactgtgattaatatttgcagttgtatattttacatttaaattattttaaggtttgcatttgtatgcttaagacattgatttcctgttggtagatgtattttatcctcacaatttagatgtagctgctttaaatttattgatgtatttcgacagagtcgtctggaatgctttatcttctgaagcttaaaaatgtactgtttgtgcaaatcatgatctgtttcacattccttggagtaccttgttagtgatgaagtaataaagcctctaagatgtttttgttgtatgacctctgtatattaatttttaaaagtacatatgaatgcattttttgatgtgttctttatgcattttcatattataaattttaaatcatgcagtttaacaaggatgtgattcattatgtggttttccttcccaatttttacttttctaatttttataaataatacacttttctattaggctagtgaatttgaaagttttgaacatgatgtgttactaatatgctgaattctatttattttatttgactgaaagcatattgagccttgctttagaaaataagttaccaaatttttttgcattgagttgtcacccagtttgtagtgctgtcttaattgaattgcccatgtaaattactagattaaattgaggacagaaaagttttttactcatcctaagctgtttttttctggaaagtaatgacaatttgaagaaatgagaacctccagatatatttggcaaattattaaagattcagcact

SEQ ID NO: 458758 - DNA, 2954 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcaggtaagttcacgatcattggtgataattttaaagatttatttgtttaagtttgccttgttttctgtaaatacgagaaattcttggatgacgcaataagatacagagattgttatttgtatctagtgtgctactttgagaaagtttccttattgatagtgatgcttccactgttcggtttatcctggtgttttttcttttaaggaaaaaatagaaatatttagttttttggtgcttaccgttgttgtgttataacaatatcgttaacatcgtcaggactttgttcctgataataaaaagcatcgatagaagccgggaccttacctttctttcaacttttgacagtaaatacctgggcacaggacttcaaagcaaacacagattccccctcccccttaatatttaagaattaaaagatgatgagaaataaggacaaaagccaagaggaggacagttcgctacacagcaatgcatcgagtgagctatcaactttcttcctttttgtctttttttttgggggagaaacctcagcttacaattgtttaccttgacagacatggattgctgtctgttttattgtgtttttctaatttggattcgttttttaaagcatgaccttgagattgctaatatgccacaccctaattttttggtagcaatttatgaaagttgagttgtgacttaaggcctcttacagcagtcaaaaggtaaggtacctttattcaaaggggcctttactgtaatgtacagtttttctgtcagtaaatttcagtttttaggtttttgtactgcagaaaaatgaccttgtcggtttagccattgctgcattgcaccattttacatacaaggcaaattttttctttgaagaatccaggatatctaaacttgtaactgagggccatagagaagccttgtagtagtaaattatagtaaatagacatatcagaaagttatatgaatgaaaaaatgtacatttaaaaacaaaatcacttaaaggaccctttgactgatgcctctcagtttatatttttatgtgactttatatttcttttgatacacttgacattttaggaaattttgatgtgatttatcaaaacctttacttgatggttagagttcctgcatttatgaaatcaaatctgtaataacagaaatcctggaatactcttaatatatacttctattttgtgtttgttactgtgattaatatttgcagttgtatattttacatttaaattattttaaggtttgcatttgtatgcttaagacattgatttcctgttggtagatgtattttatcctcacaatttagatgtagctgctttaaatttattgatgtatttcgacagagtcgtctggaatgctttatcttctgaagcttaaaaatgtactgtttgtgcaaatcatgatctgtttcacattccttggagtaccttgttagtgatgaagtaataaagcctctaagatgtttttgttgtatgacctctgtatattaatttttaaaagtacatatgaatgcattttttgatgtgttctttatgcattttcatattataaattttaaatcatgcagtttaacaaggatgtgattcattatgtggttttccttcccaatttttacttttctaatttttataaataatacacttttctattaggctagtgaatttgaaagttttgaacatgatgtgttactaatatgctgaattctatttattttatttgactgaaagcatattgagccttgctttagaaaataagttaccaaatttttttgcattgagttgtcacccagtttgtagtgctgtcttaattgaattgcccatgtaaattactagattaaattgaggacagaaaagttttttactcatcctaagctgtttttttctggaaagtaatgacaatttgaagaaatgagaacctccagatatatttggcaaattattaaagattcagcact

SEQ ID NO: 458759 - DNA, 4332 bp, Homo sapiens
  misc_feature (3813)..(3816): n is a, c, g, or t
  misc_feature (3890)..(3890): n is a, c, g, or t
  misc_feature (3897)..(3897): n is a, c, g, or t
gtcttgctttgtcacccagggtagagtgcagtggcgcgatctgggctcacagcagcttccacctcctgggttcaagtgattctcctgccgcagcctcccaaatagctaggattacaggcacctgccaccacacctggctagtttttgtatttttagaagagacagggtttcaccatgttggccaggctggtgtcaaactcctgacctcaggtgacaggtctgcctcagcctcccaaagtgctggaattatgagcatgagccactgtgcctggccaatacatacgtacatttaaatactagcaacctaatcagttattagctgactttgtataggtatataatctctttggtactcagtttccatccgtgaaatgagaataataaacttacgttgaagggttgctatgagaattaaatgagaggatatcagtaaagagcttctgcctctacagttgtaactggttattactggaaagtttagacttctctgagtcccttgaggctatttgcttgaaaacaagcttctaagtatagacagtgatgaaccactgggggcagtgcttctttttccagaaagtacataagtagatataaaatttgtagcaaaaattcatagccctgttttgtttcctaggatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttctgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccaaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttggcgcacagttccgcaggctgtacaagcatagcaccagcatctggttggcttctggagaggcctcagggagcttttactcatggtggaaggtgaagtggcagtaggcgtcccatggcaagagagggagcaagagagagaggaggaggtgccagcctcttttaaagcaccagctctcacgtgaactcagagaactcactcattatcacaaggacagcaccaagccatttatgagggatctgcccaaacacctcccactacannnnggaagagcccgagcgtggctttatcttgcactcatgcaaaagaaactggcagattatctgaaagtgcctatagncaataancatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagaga

SEQ ID NO: 458760 - DNA, 3369 bp, Homo sapiens
  misc_feature (2850)..(2853): n is a, c, g, or t
  misc_feature (2927)..(2927): n is a, c, g, or t
  misc_feature (2934)..(2934): n is a, c, g, or t
ggtacttagcagtaatggtcaaactcagcataaattccactgagttcccccagcaaatagcctaacagtggaatttatgagccttttttttgttaggaggtagtaaacgccagttcagaagtttaagaaggacaagaaggagctgtttagaggtgatagcctttattcttctctggggaattaagcctgggatcttgagcttctttggtttccttttactctttaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttctgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccaaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttggcgcacagttccgcaggctgtacaagcatagcaccagcatctggttggcttctggagaggcctcagggagcttttactcatggtggaaggtgaagtggcagtaggcgtcccatggcaagagagggagcaagagagagaggaggaggtgccagcctcttttaaagcaccagctctcacgtgaactcagagaactcactcattatcacaaggacagcaccaagccatttatgagggatctgcccaaacacctcccactacannnnggaagagcccgagcgtggctttatcttgcactcatgcaaaagaaactggcagattatctgaaagtgcctatagncaataancatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagaga

SEQ ID NO: 458761 - DNA, 356 bp, Homo sapiens
gaaaaaagcaagattcttctgatgaggatgatgatgatgacgaagctcccaaaaggcagactcgtcgaagagcggctaaaaacgttaggtaagttgtaccccagaagtgtttcactggtgtgatgtgataaagtagttggttagattttggttctcataagtccggggttgtgcacttaatagataaaaataacagcctatgtcctgaagttgttttcagaaatctggttagctttcttgcaaaaagagtggtattgagccaaggggaataggaaaagagtagcaatagctcatttgaagccttcattcctaaaaaacaccacaagttcgtgtcctgtccaatggtgacttagtgg

SEQ ID NO: 458762 - DNA, 393 bp, Homo sapiens
caaaaaaagaaatttgagtttttatgctttgatgccgaatatgtgaattgtggctagcgttttaacatagtagcagtaagaacattttctcagacttgggcttttgtttttcaggccctgaagcagagaccacgatttgtagctttaaagaaacaacctgcatatttaggaggggagaatctggaacttcgagattatcagctagaaggtctaaactggctagctcattcctggtgcaagtaggtagaaaaatatgagtgcaattttccttactgtttctggcttctttattgttagatgtcaagaattttttttttcttttttcacacccttattgtatctcaaccaagaaatctttatgctgcatattacagaaataaaagatgattgaga

SEQ ID NO: 458763 - DNA, 309 bp, Homo sapiens
acttatttcaagttgaagtattttggtgcttcatccacaaagggagtcttcagataattgcattcttgggaagctttttaatatctggtgtaatatactctctttcaagtgtacttaatccttttgcagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaa

SEQ ID NO: 458764 - DNA, 334 bp, Homo sapiens
gtggttcaggcataagcataacagttccttttcctacaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaagtaagtgccaggaagattgggaggtaggcagaatcaaattgattctacatcactgttggatataataggattttctaccacagacattagtctgttcattacctggaagatgccaggccagaaccacaaataggatagcattttca

SEQ ID NO: 458765 - DNA, 327 bp, Homo sapiens
cacttgttacagtgtgactttgcctcgatctttctcaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttggtggaggctctgttctcactgagcttgtttgaaagtgcgtactgtaagtcttgggttgactggatcctggacatcgtgacagggtaggcagaggctaatacctacaaaa

SEQ ID NO: 458766 - DNA, 2723 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaagtaggtagaaaaatatgagtgcaattttccttactgtttctggcttctttattgttagatgtcaagaattttttttttcttttttcacacccttattgtatctcaaccaagaaatctttatgctgcatattacagaaataaaagatgattgag

SEQ ID NO: 458767 - DNA, 9027 bp, Homo sapiens
  misc_feature (8508)..(8511): n is a, c, g, or t
  misc_feature (8585)..(8585): n is a, c, g, or t
  misc_feature (8592)..(8592): n is a, c, g, or t
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaactttaacctagctccagggattccctgctcctggaaggaggaaatccacgacggctgggatgctctagcagatgaagccacaagcccctcctacctgagttgttctaccctgttaacagcacagattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttctgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccaaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttggcgcacagttccgcaggctgtacaagcatagcaccagcatctggttggcttctggagaggcctcagggagcttttactcatggtggaaggtgaagtggcagtaggcgtcccatggcaagagagggagcaagagagagaggaggaggtgccagcctcttttaaagcaccagctctcacgtgaactcagagaactcactcattatcacaaggacagcaccaagccatttatgagggatctgcccaaacacctcccactacannnnggaagagcccgagcgtggctttatcttgcactcatgcaaaagaaactggcagattatctgaaagtgcctatagncaataancatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagaga

SEQ ID NO: 458768 - DNA, 5831 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacactccgatttccggatttactgggatcctctgaacgactatgcccactaatca

SEQ ID NO: 458769 - DNA, 5867 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggtaaccactttggcctcgtctgcccagtttgatttgactgagtgtgggagtggattctgttttcttttaataaaaggtggcatagccacctaagaaatctttctcccagcacaactcatctattggcaatatacctgcaggctttaactccctttccatgaaataggccattccactgagaccagccttttgaaggggtaggacgat

SEQ ID NO: 458770 - DNA, 5386 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaaaggctgaaaaactagatcaactaaacacatttcatgaaaaaagctgattcttaataaataataccaactgatacaatgatgaaaa

SEQ ID NO: 458771 - DNA, 5521 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaactttaacctagctccagggattccctgctcctggaaggaggaaatccacgacggctgggatgctctagcagatgaagccacaagcccctcctacctgagttgttctaccctgttaacagcacagattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgcccaatcttcgatttgacgcgttcgggatcctcag

SEQ ID NO: 458772 - DNA, 5585 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaagtaaccctaccatgctagagatttctagaagatttgttgtgtaatatttttatatcgattacttatttctaactattttcgagggggcatcaaattagaaattagtatagtcattcttggaaatacttccatctttagcagattgtggcactgtttcacggatgaagataaagggaaaagacagtagccaggtgaaattttggggaaactgtaggagaaatcttaaaattctggtatttaattataggtcagatttcattacaataaatacccaggtgagtttgttaatgataaaagcattccttggccttagttattggccctttgtttaaaagtacatttgaaacaaccatatttcatttcctcacgtaaagattgaatgtcaccttggtattctttgtaatggaattaaacattggctgttcttctcccacaaaatcgagcctcccaccctatctgttgcaagtagcaaggccatggttggagctataagcagggaaggctgactggctcaaattttggtaggatttgctccatgttgtgctcctggcacgttcaacagtgctcatcccatctggttttaggagggtgacagcaccctgccttaagcactgagaccagattcagtctgg

SEQ ID NO: 458773 - DNA, 9191 bp, Homo sapiens
  misc_feature (8672)..(8675): n is a, c, g, or t
  misc_feature (8749)..(8749): n is a, c, g, or t
  misc_feature (8756)..(8756): n is a, c, g, or t
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaatgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcaggtaagttcacgatcattggtgataattttaaagatttatttgtttaagtttgccttgttttctgtaaatacgagaaattcttggatgacgcaataagatacagagattgttatttgtatctagtgtgctactttgagaaagtttccttattgatagtgatgcttccactgttcggtttatcctggtgttttttcttttaaggaaaaaatagaaatatttagttttttggtgcttaccgttgttgtgttataacaatatcgttaacatcgtcaggactttgttcctgataataaaaagcatcgatagaagccgggaccttacctttctttcaacttttgacagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacaatggaagatgaagaagagctagaagagcgtcctcacaaggactgggatgagatcattccagaggaacaaaggaaaaaagtagaggaggaagagcggcagaaggagctagaagaaatttatatgctgcctcgaattcggagttccactaaaaaggctcagacaaatgacagtgactctgacactgagtctaagaggcaggcccagagatcctctgcttctgagagtgaaacggaagactctgatgatgacaagaagccaaagcgcagagggcgtccgaggagtgtgcggaaggacctcgtggagggatttactgatgcagagatccgaaggttcatcaaggcttataagaagtttggtctccctcttgaacggctggagtgcatagcacgtgatgctgagctggtagataagtcggtggcagatctgaagcgcctgggtgaactgatccacaacagctgtgtgtcagcaatgcaggaatacgaagagcagctgaaagaaaatgccagcgagggaaaaggaccagggaaaaggagaggtccaacaatcaagatatccggagttcaggttaatgtgaaatccattatccaacatgaagaggagtttgagatgctgcataaatctatccctgtggaccctgaagaaaaaaaaaaatactgcttaacctgtcgtgtcaaagctgcacattttgatgtagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttctgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccaaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttggcgcacagttccgcaggctgtacaagcatagcaccagcatctggttggcttctggagaggcctcagggagcttttactcatggtggaaggtgaagtggcagtaggcgtcccatggcaagagagggagcaagagagagaggaggaggtgccagcctcttttaaagcaccagctctcacgtgaactcagagaactcactcattatcacaaggacagcaccaagccatttatgagggatctgcccaaacacctcccactacannnnggaagagcccgagcgtggctttatcttgcactcatgcaaaagaaactggcagattatctgaaagtgcctatagncaataancatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagaga

SEQ ID NO: 458774 - DNA, 4180 bp, Homo sapiens
taaagaaggaaaaacttgaatttatattatgaaattaaggttttacttttatttagcaatcatttcacccattgggggattaatttttaaaaagattagtacttagctgagctttagattctctaagaattatccctttttcaaaatggcttgataaaacaccacttcctgtccagggaggaagttattttagctcaaggactgaaatatttagcagatctttagacaaaaggaacaaattacatttctctctggcttaaaaagggtgcttgagccagagggggttaagaagccctcccccctccccctgttggggtggtctggaggggcagggaggtgtgggggtgggggtccttaggctccctgggatggaggatctgtctctctctctctctctcctttttttttttttggtggagatgaaggggtgggtctatggtacatcacctgagttgtggggtaaatgtagagagtgtcaatcaaaggcagagctctcagagctgggaaggaggctctagatggcggctgtgccttagagagagcgcgctctgctccctgcctttgcctcactttacgcaactttccctaactttcgggcagcctcagggggcccccgtagccccctgcctttcctagggacttactggggtcgattcgaacctttttttgggagaaaagcagcttttaggagctttcttttcgtgccttgttggaaagaagcagccgtactgagagcccaggtcgttgttttttccagcttagaagccatggcgcacctccatttttgtgcgctctcctaatgaggttttttttctttcggacctgttttagtattaattattgctttatttttttgaccagttaacatatttgagggttattttatttatttttcgttttttaacggaggattttgcctttatttttaattatttgggatctgatatttttctactagtagataggactcttggtttggacatactacatggatcagtaaatacctgggcacaggacttcaaagcaaacacagattccccctcccccttaatatttaagaattaaaagatgatgagaaataaggacaaaagccaagaggaggacagttcgctacacagcaatgcatcgagtcactcagcctctgaagaagcttcgggttcagactcaggcagtcagtcggaaagtgagcagggaagtgatccaggaagtggacatggcagcgagtcgaacagcagctctgaatcttctgagagtcagtcggaatctgagagcgaatcagcaggttccaaatcccagccagtcctcccagaagccaaagagaagccagcctctaagaaggaacggatagctgatgtgaagaagatgtgggaagaatatcctgatgtttatggggtcaggcggtcaaaccgaagcagacaagaaccatcgcgatttaatattaaggaagaggcaagtagcgggtctgagagtgggagcccaaaaagaagaggccagaggcagctgaaaaaacaagaaaaatggaaacaggaaccctcagaagatgaacaggaacaaggcaccagtgcagagagtgagccagaacaaaaaaaagtaaaagccagaagacctgtccccagaagaacagtgcccaaacctcgtgttaaaaagcagccgaagactcagcgtggaaagagaaaaaagcaagattcttctgatgaggatgatgatgatgacgaagctcccaaaaggcagactcgtcgaagagcggctaaaaacgttagttacaaagaagatgatgactttgagactgactcagatgatctcattgaaatgactggagaaggagttgatgaacagcaagataatagtgaaactattgaaaaggtcttagattcaagactgggaaagaaaggagccactggagcatctactactgtatatgcgattgaagctaatggcgaccctagtggtgactttgacactgaaaaggatgaaggtgaaatccagtacctcatcaagtggaagggttggtcttacatccacagcacatgggagagtgaagaatccttacagcaacagaaagtgaagggcctaaaaaaactagagaacttcaagaaaaaagaggacgaaatcaaacaatggttagggaaagtttctcctgaagatgtagaatatttcaattgccaacaggagctggcttcagagttgaataaacagtatcagatagtagaaagagtaatagctgtgaagacaagtaaatctacattgggtcaaacagattttccagctcatagtcggaagccggcaccctcaaatgagcccgaatatctatgtaaatggatgggactcccctattcagagtgtagctgggaagatgaagccctcattggaaagaaattccagaattgcattgacagcttccacagtaggaacaactcaaaaaccatcccaacaagagaatgcaaggccctgaagcagagaccacgatttgtagctttaaagaaacaacctgcatatttaggaggggagaatctggaacttcgagattatcagctagaaggtctaaactggctagctcattcctggtgcaaaaataatagtgtaatccttgctgatgaaatgggcctaggaaagaccatccagaccatatcattcctctcctacctgttccaccaacaccagctgtatggcccctttcttatagtcgtccctttatccaccctcacctcatggcagagagagtttgaaatctgggcaccagagattaacgtagtggtttacataggtgacctgatgagcagaaatacgatacgggaatatgaatggattcattcccaaaccaaaagattgaagttcaacgcacttataacaacatatgagatcctcttgaaagataagactgtgctgggcagtattaactgggcctttctgggagtggatgaagcccatcggttgaagaatgatgactctttattgtataaaactctgattgatttcaagtccaaccataggctcctgattacggggacccctcttcagaattccctcaaagagctctggtccttgctgcactttattatgccggagaagtttgaattttgggaagattttgaagaagaccatgggaaggggagagagaatggctaccagagtcttcataaggtgctagagcctttccttctccggagagtcaaaaaagatgtggagaaatcccttcctgctaaagtggaacagattctcagggtggagatgtcagcccttcagaaacagtattacaagtggattctgaccaggaattacaaggctcttgccaaaggaacaagaggcagcacatctggttttcttaatattgtgatggaactgaaaaaatgttgcaaccactgctatctgattaaaccccctgaagaaaatgaaagggaaaatggacaggagattcttctgtccctcataaggagcagtgggaagttgattttattagacaaactgttgacaagacttcgagaaagggggaatcgagtgcttatcttctctcagatggtgagaatgttggatatcctggctgaatacctaactattaaacactatcctttccagcgtctggatggttccatcaagggagaaatccgaaaacaggcactggaccacttcaatgcagatgggtctgaggacttctgtttcctgctctcgacaagggctggtggcctgggaatcaatttggcttcagcggacacagtcgtcatctttgactctgactggaacccccagaatgacttgcaggcacaagcccgagcgcatagaattggtcagaagaagcaggtaaatatttaccgcttagttacaaaggggactgtggaggaggagatcatagaacgggccaaaaagaagatggtattagatcatctggtgattcagcgcatggacaccactggccggacgatcctggaaaacaactcaggaaggtccaactcaaatccttttaataaagaagagctgacagctattttgaaatttggagcagaggatctcttcaaagaactggaaggggaggaatcagaacctcaggaaatggatatagatgaaattttgcggttggctgaaacgagagagaatgaagtgtcaacaagtgcaacagatgaacttctatcacagtttaaggttgccaactttgcaacatggatacagaagaggagacgggatcctc

SEQ ID NO: 458775 - DNA, 4017 bp, Homo sapiens
  misc_feature (3498)..(3501): n is a, c, g, or t
  misc_feature (3575)..(3575): n is a, c, g, or t
  misc_feature (3582)..(3582): n is a, c, g, or t
gggattttcagtgactgggagccatggacatgagataggatctgaggctttatctatattttgggtgattctgccggtggagacagataaaaagcctcaggggaagcagctacagacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatgaaaaaaaaacagaagaagaaagagaacaaggagaacaaggagaaacaaatgagttctaggaaagacaaagaaggggacaaggaaagaaagaagtcaaaagataagaaagagaagcctaaaagtggtgatgccaaatcttcgagtaaatcaaagcgatctcagggtcctgtccatattacagcaggaagtgaacctgtccccattggagaggatgaggatgatgatctggaccaggagacattcagcatatgtaaggagaggatgaggcccgtgaaaaaggcactgaaacagctcgacaaacctgacaaggggctcaacgtgcaagaacagctggaacacacccggaactgcctgctgaaaatcggagaccggatagccgagtgccttaaagcctactcagatcaggagcacatcaaactctggaggaggaacctatggatttttgtttccaagtttacagaatttgatgctcgaaaactgcataagttatacaagatggctcataagaaaaggtctcaagaagaagaggagcaaaagaagaaagacgacgtgactgggggtaagaaaccatttcgtccagaggcctcaggctccagccgggactctctgatatctcagtcccatacctcacacaaccttcaccctcagaagcctcatttgcctgcctcccatggcccacagatgcatggacacccaagagataactacaatcaccccaacaagagacacttcagtaatgcagatcgaggagactggcagagggaaagaaagttcaactatggtggtggcaacaacaatccaccatggggaagcgacaggcaccatcagtatgagcagcactggtacaaggaccaccattatggggaccggcgacatatggatgcccaccgttccggaagctatcgacccaacaacatgtccagaaagaggccttatgaccagtacagcagtgaccgagaccaccggggacacagagattattatgacaggtatgcaaaaggctgtgagacaccaggtgccaacctttgccaggagctgtttctagggagaaagtgacgtatacatgaatgtatttatctatcaaattactgaagatctcatcatgcatgtgtcagccacagcgaatcccatgtcttggttataggttttatgttttgttttctgggtcatagggagcacatttcacctgtgcaggaaaagagttttctgccgtcttttgaggaaatctagtgaagaggtcgccataaaatattagagtcaacaaccaaaattattaagctctgtgcgaggctgtcagccacactaggtatcagggatcccgagatgggtaccagcccacagtccttacctgccacgagcccataattgaagagtcaaagtcttctgaagctgcaccctctttacttcagtacaatgccaccagtagtacgatgagccaaagctttacattgtgagagtagcaagtccagggagagctaaagaggttttatctgtatttcctaatttcaaatcttggataatttaacctcatagcagctttggttttccctgggctgatgatgtgcgtcatttgcactgtaccttgaatttacagtgggaaaatttcatataaacgtgtcaaagtcgtgctttgtttttggaagatctggtaacagcagcccgcattagcagagagctgtagctgagtagctgccacctcgttgggagactgcccctcgctcccacccttctctattgtctggacccagtgggcatcttgccctgcgttcttctagtaggtctgtatttctatttgatgtcactttccttttgcctgaaggactttttctgctggtgataaactctttcagtgtttgtatatatgcctgaaaaagtattttgccttcatttttgaaagtagtttttgctgagtgtatacatttttggctttacagtttctttcagtgctttaaagatgtacctctgctatttacttgcattgttttgtgatgaaaaatctgtcatccttatctttgttcctctttacataatgttccttttaaaaaaaatcactgattatgatgtgccttggtgtatttttccttggtttcttgtgcttggaaatttttgaacttcttggatctgtgggtttattgtttccataaaatttggaaatttttacaatcttcttcaaatattttttctgatcccccactctctcttcttctttggagattctcattacacctatattagcttgcttgaagttgtctcacagctcacttgtattctgttgacttttaaaaaattatgctttctgtttcactgtggatagtttctattgctacctcttcaagttcactaatactttccttttcaatgtcaagactgctgtgaggcccatccagtgtactttgcattttatacattgtagttctaaaagttcggaaagttgtttttgggtctttttatatatgttctgtgtctaaccttttaaaacctggaacacagatataacaatggttttgatgtccttgtctgcgaatcttatcacttgggtcagtttcagttgatacctcctcactgtgggtcttgctcccctggtgctttctgtgcctagtaatttttgtcagatgccagatgtaacatttaccttgttgggtgctggatatttctgtattcctgtaagtattctggagctttgttatgagttgcaggttatttggaagcagtttcctttttcaggtcttgctgttaagattcgttaggtagaaccagagcagtgctcagtcaagggctaatgattgcccacccccaaggtaaagagcctcattgcactctacccaattgcgttagtctgttttgcaggaatacctgaggctgggtaatttatagagaaaagagttttatttggcgcacagttccgcaggctgtacaagcatagcaccagcatctggttggcttctggagaggcctcagggagcttttactcatggtggaaggtgaagtggcagtaggcgtcccatggcaagagagggagcaagagagagaggaggaggtgccagcctcttttaaagcaccagctctcacgtgaactcagagaactcactcattatcacaaggacagcaccaagccatttatgagggatctgcccaaacacctcccactacannnnggaagagcccgagcgtggctttatcttgcactcatgcaaaagaaactggcagattatctgaaagtgcctatagncaataancatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagaga

SEQ ID NO: 458776 - DNA, 128 bp, Homo sapiens
cagataaaaagcctcaggggaagcagctacagacccgagcggattacttgttgaagctgctcagaaagggtctggagaagaagggggctgtgacaggtggggaagaggtgagtacgctgccagctggt

SEQ ID NO: 458777 - DNA, 2377 bp, Homo sapiens
  misc_feature (13)..(13): n is a, c, g, or t
agtaattccgggnagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcgggtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaagttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaacctgggtgtcctcactgctgccctgagtccagccatggttttcagggggacagtggacagggactcagaaatgtggtgggagggcctccctggcttgggagaccgctctctgcaagggagggggagagaagcagagggagagagaaggtgacacggatggaagagtgggaaggagctggcctggctcagccctaggctgtccctgcagccagggtgtccgggggctggccagtcagagaaagggggccatggactgctgtggcaaatagggagacaaggagacagaccctgcagtcctactacagtctggagtggggtcctaagaagaagggtcccacctcaacccctgtcagtgtccactgtggggtgggggctgacccctgcctttgattgtcattctcctgggaagcccagtctcagtccctcccccaacactgtccacactgcccctccccactgtttatttattgcacggatctaagttattctccccagccagagcccgagctcctgctccctgggaaaagtggcgtatggccctgagctgggctttatattttatatctgcaaataaatcacattttatcttatatttagggaaagccggagagcaacaacaaaaaatgtttaagccgggcgcggtggctcacatctgtaatcccagcactttgggagtccaaggagggggatcgcttgagtccaggagtttgagaccagcctggacaacatggtgaaaccccgtctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaaatcctgtctcaaaaaaaaagttaaaaaatattgcccggctcctagaatttatttatttcctgacttacagcaagcgagttatcgtcttctgtattttgtagactttctaaataaagtcaaattctttctttttccacagagaa

SEQ ID NO: 458778 - DNA, 1513 bp, Homo sapiens
  misc_feature (13)..(13): n is a, c, g, or t
  misc_feature (1402)..(1402): n is a, c, g, or t
  misc_feature (1463)..(1463): n is a, c, g, or t
agtaattccgggnagctcgccttacaactccgcgcggcctcggccccctgcgccgcccgccccacaacaaaactcagcgcagcgctcccgggcgcccggttcagagcgacctgcggctcagagcggaggggagactgaccggagcgcggatcgggacagcggccgggacagcggcgagacgcgcgtgtgtgagcgcgccggaccaagcgggcccagaagcgggtctgcagcccagagggcaccttctgcaaacatgtctgtggatcccctatccagcaaagctctaaagatcaagcgagagctgagcgagaacacgccgcacctgtcggacgaggcgctgatggggctgtcggtgcgcgagctgaaccggcatctgcgcgggctctccgccgaggaggtgacacggctcaagcagcggcgccgcacactcaaaaaccgtggctacgccgccagctgccgcgtgaagcgcgtgtgccagaaggaggagctgcagaagcagaagtcggagctggagcgcgaggtggacaagctggcgcgcgagaacgccgccatgcgcctggagctcgacgcgctgcgcggcaagtgcgaggcgctgcagggcttcgcgcgctccgtggccgccgcccgcgggcccgccacgctcgtggcgccggccagcgtcatcaccatcgtcaagtccaccccgggctcggggtctggccccgcccacggcccggaccccgcccacggcccggcctcctgctcctagtgcccgcccccgccatgcctcagccacgcccctccggcctcagctccctccccaaagtgcctgagcgccgcctctgtgcccaggtcccatttctctgcagcactggccccttggtgcacacacattcccttcgtgggccctgtcttcctcttgcagccccccaaactgggaccgaatgaccctgggaaggggaagttgggtaggttggggatggggcagaggtctggatctgggatcgcccttggctgaaagtttagcctttttagattgagagatacagagccggcttagagaacagctgttgggggagaagagggcacccctcatcttggaaactgctcttattgtgccaatatgccctccaaaccctcccaggattcaaagctaggtttggctgtctgtgacttacgggaccgtcctgctgagaaattgcactgaagagatgcccccacctctggttgggcctgggggtgcctggccttccgaaactaaaagagtgggtgggaagactagtgaaacccagttcacggatggggaaacaggcctgaggtcacatttcacttagtggttgtgttgggaccaaaaactaaggcggctgcagcaaagcagaccttcgcatcaacacagcagacaccaaaaacccagttgagagcnccgctctcctaccggcccggccccagcactcgctaagcttttcctgacaccttggaactgntgcacctgggcaaccaagccggaaaattaaacttccaagcaggccagtaa

SEQ ID NO: 458779 - DNA, 4326 bp, Homo sapiens
tagcgggcagttggccggaagtggggctgtgaggctcggagtcgccggaggagccagtatctgtgtcgccgccgcccgcggcgtccccggtttggtgttgcggcgcccaccttcgggaggatcaggctgcttctgatgcttggaagatatcctctcagccacaaagatggtaataaatctttgcctcccacagttcagaccaagaattcactgcaacaagatatcagctgatggttacgaagtagaaaatctcatctctgaagatctcacaaagagaagtcatggtttcaggacagagtatttcattaagccaccagtctatgtgacagtttcatttccctttaatgtggaaatctgtaggatcaacatagacctcacagctgggggaggtcagaacgtcactggcctggaaatgtacacatctgcctcatctagcagagtgtcttggaatacgccccagtgccggaccctgggcccagctgagccatctgtcccagacaaggaggcgttcaccttggtaggcaaagtcttactgaaaaaccagagccaagtggtgtttagccacaggggcttcaaggccaggcccccttttggcgcgatggaagccacactcccctcccctgctgttgtggcccaggagctctggaataaaggggctctttcccttagccacgtggcccacttaaggatctgtatcacccatgtgacaggcggcggtatcccttgtatcaagcggttggaagtgtggggtcagccggccaagacctgctcccaggaagtgatagacagcatcctgctggtcacctcagagaacctgcctcaggatgtggctctgcaggctccagccttgcccatggaaagtgactgtgaccctggggaccagcctgagagccagcaggctccctccagcctgcagaagctggccgagatcattcaggatgtgcctgaggagttcctggatcccatcaccctggagatcatgccttgtcccatgctgctgccctcaggcaaggtcatcgaccagagcacactggagaagtgtaaccgcagtgaagccacatggggccgagtgcccagtgaccctttcacgggggtagcttttactccgcactctcagcccctgcctcacccctccctcaaggcccggattgaccatttcctgctccagcactccatccctggctgccacctgcttgggagagcacagacggcattggcagtgatcccttcttccattgttctgccctctcagaaaaggaagatagagcaggctgaacatgtcccagacagtaactttggtgtaaatgcttcctgtttttctgccacaagccctttggtcttacccactacctcagagcacactgctaagaaaatgaaagccaccaatgagcccagcctgacacatatggactgctcgacaggtccactgtcccacgagcagaagctgtcacaaagcttggaaattgccttggcatccacccttggctctatgccctccttcacggcacggctgaccaggggacagctccagcaccttggcacaagagggagcaacacttcctggaggcctggcaccggctcggagcagcctgggagcatcctgggccccgaatgtgcctcctgcaaaagagtattttctccctacttcaaaaaggagccggtgtaccagctgccctgcggccacctcctgtgccgaccctgcctgggtgagaagcaacgctccctgcccatgacgtgcacagcctgccagcggccggttgctagccaagacgtgctgcgggtccacttctgagtgactgacctccactggaggagacccattgctgggaggagctgagggggaacaggagcagggccacagcacccctgaggtctggccaggccccaggcacagagctgcctgctccctcccggggctcttcttcatcacctcacggtatagcacattgcttctgcgctggtggcaatagggcaacaaagccataggccagagggcggggggatgtccctgcctccctgccaccccccctgcctgagcccaggacccactggagccagccccaccctaggcaggaagacccctgctgagggcccccccgtgcagtccgcatacccccctgtccagcagggcactgtgggtggctcaccctagattgtggcccagatctcaggagtctctgccttcagggtcatccaaaagtggaccttgggagcagtgggggtgtctgtggagtgcatgactcagccccccgactcgcagccttaataaagcgatggttgacgtctgctgtgggtttcctcctggtggagtgcctgtctgtgtcacacactcctgtcgcccacctgcacccacacaagtggagctcacagggtagctgtgtgcagtcactgcagcttgccaggctgtcattcctgtcgacgacctgaaaggacacaaactggaattttcaggtctgtcccctgcatggggactcagaacccaggtttgcaggtgggcatacgtggtgggagggtggagggctccctctggccagtgccagctgtgctcagctggcttcagaaactgctccctgagggggagcgcagcgtttcctcatgcagttggtttcaggaaaaatacttgtttataggctgcatccttttttcagcccaacatttagctttatggagtgccaaagggaaaatatatccatatccctacaacttggtactctatcagattccagccactagaagaacctcagtgagaaaacacacccgcctttccctgttcccttctaagcacgtttgggaaggaacagcctaaagatgctttgtaaagctgtattttacccttgagcttagccgcgggtccctgtgaaccggcacattcctttcctttaggccgtccagagctctagtccacacccaatactttagagatctgggtttggggttagttgctttttttttttttttttttaattgagacagggttggtctctgttgcccaagcttgagggcagtggtgcaatcataactcattgcagcctcgaactcctgggcttaagggatccttctacctcagcctcccaggtagcaggaactataggcatgtgccaccatgcccagctaatttttttattttttgtagagacaaggtcttgctatgttgtccagactggtctcaaactcctgggctcaagcgatactcccagagtgcttggattgcaggcatgagccacttcgcctagccaagcctgcatttttttgagttcctacatcatttgtccacaaagatggcttcagagaggtggtcacatgctttgctctgcttcctcttggcactgaccttgatgcagccttcacatgagatttgagggtccgcatggatggcctgtgccgccctcgctggcgaggctcctgtgtgcccctggctttctgggtctgtgcctctccagaatcttgtcttaccctccggtgtgcttgtgttcttagaaaagccccagcatggccgggcatggtggctcatgcctattatcccagcactttgggaggccaaggtgggtggatcacttgaggtcaggagttcgagaccagcctggccaacatggcaagaccccatctctactaaaaatacaaggattagctgggcatggtggtgtgtgcctgtaatgccagctactcaggaggctgaggcatgagaatcgcttgagccggggaggcagaggttgcagtgagccgagatcgcaccactgtactccagcctgggcgacggagtgagactccctctcaaaaaaagaaaaaagccccagcatgtagcaaaagcatttcttggtgagtgtgggggctggtgattcccaccttcaccctgtcatggtctcagggaacagcctgcttcccaccagcagcttgacacccacagtgtgctctggctgctgggagcccatctctcggagaaaccctgtccacccaaccccgagagccctagcgtgcagtcagcgtcagcacggcgctcccagatgagggccggactgcctccccttaagcagctgtgttggaggtactgcccagaccgctgcaggtccctggggatctgcatttctaacaggctcctgcccccaagactgctctggtggaaaatccagcctgggagcccctggagtggcaggccctgtcctgggtacaggtggagccacccccaggagttgcgtgtgtttttcttaattgaaagacttcccccaaaaggaagtggtcttttcactacccttgccagaaacatgctaggcaccactgggctctgtttctgtcccctagaaaatgggaataaaatttcttttgctgtca

SEQ ID NO: 458780 - DNA, 8229 bp, Homo sapiens
  misc_feature (2785)..(2785): n is a, c, g, or t
  misc_feature (2800)..(2800): n is a, c, g, or t
  misc_feature (2803)..(2803): n is a, c, g, or t
  misc_feature (2812)..(2812): n is a, c, g, or t
  misc_feature (2850)..(2851): n is a, c, g, or t
  misc_feature (3603)..(3603): n is a, c, g, or t
  misc_feature (5223)..(5223): n is a, c, g, or t
tagcgggcagttggccggaagtggggctgtgaggctcggagtcgccggaggagccagtatctgtgtcgccgccgcccgcggcgtccccggtttggtgttgcggcgcccaccttcgggaggatcagctgcttctgatgcttggaagatatcctctcagccacaaagatggtaataaatctttgcctcccacagttcagaccaagaattcactgcaacaagatatcagctgatggttacgaagtagaaaatctcatctctgaagatctcacaaagagaagtcatggtttcaggacagagtatttcattaagccaccagtctatgtgacagtttcatttccctttaatgtggaaatctgtaggatcaacatagacctcacagctgggggaggtcagaacgtcactggcctggaaatgtacacatctgcctcatctagcagagtgtcttggaatacgccccagtgccggaccctgggcccagctgagccatctgtcccagacaaggaggcgttcaccttggtaggcaaagtcttactgaaaaaccagagccaagtggtgtttagccacaggggcttcaaggccaggcccccttttggcgcgatggaagccacactcccctcccctgctgttgtggcccaggagctctggaataaaggggctctttcccttagccacgtggcccacttaaggatctgtatcacccatgtgacaggcggcggtatcccttgtatcaagcggttggaagtgtggggtcagccggccaagacctgctcccaggaagtgatagacagcatcctgctggtcacctcagagaacctgcctcaggatgtggctctgcaggctccagccttgcccatggaaagtgactgtgaccctggggaccagcctgagagccagcaggctccctccagcctgcagaagctggccgagatcattcaggatgtgcctgaggagttcctggatcccatcaccctggagatcatgccttgtcccatgctgctgccctcaggcaaggtcatcgaccagagcacactggagaagtgtaaccgcagtgaagccacatggggccgagtgcccagtgaccctttcacgggggtagcttttactccgcactctcagcccctgcctcacccctccctcaaggcccggattgaccatttcctgctccagcactccatccctggctgccacctgcttgggagagcacagacggcattggcagtgatcccttcttccattgttctgccctctcagaaaaggaagatagagcaggctgaacatgtcccagacagtaactttggtgtaaatgcttcctgtttttctgccacaagccctttggtcttacccactacctcagagcacactgctaagaaaatgaaagccaccaatgagcccagcctgacacatatggactgctcgacaggtccactgtcccacgagcagaagctgtcacaaagcttggaaattgccttggcatccacccttggctctatgccctccttcacggcacggctgaccaggggacagctccagcaccttggcacaagagggagcaacacttcctggaggcctggcaccggctcggagcagcctgggagcatcctgggccccgaatgtgcctcctgcaaaagagtattttctccctacttcaaaaaggagccggtgtaccagctgcctgcggccacctcctgtgccgaccctgcctgggtgagaagcaacgctccctgcccatgacgtgcacagcctgccagcggccggttgctagccaagacgtgctgcgggtccacttctgagtgactgacctccactggaggagacccattgctgggaggagctgagggggaacaggagcagggccacagcacccctgaggtctggccaggccccaggcacagagctgcctgctccctcccggggctcttcttcatcacctcacggtatagcacattgcttctgcgctggtggcaatagggcaacaaagccataggccagagggcggggggatgtccctgcctccctgccaccccccctgcctgagcccaggacccactggagccagccccaccctaggcaggaagacccctgctgagggcccccccgtgcagtccgcatacccccctgtccagcagggcactgtgggtggctcaccctagattgtggcccagatctcaggagtctctgccttcagggtcatccaaaagtggaccttgggagcagtgggggtgtctgtggagtgcatgactcagccccccgactcgcagccttaataaagcgatggttgacgtctgctgtgggtttcctcctggtggagtgcctgtctgtgtcacacactcctgtcgcccacctgcacccacacaagtggagctcacagggtagctgtgtgcagtcactgcagcttgccaggctgtcattcctgtcgatgacctgaaaggacacaaactggaattttcaggtctgtcccctgcatggggactcagaacccaggtttgcaggtgggcatacgtggtgggagggtggagggctccctctggccagtgccagctgtgctcagctggcttcagaaactgctccctgagggggagcgcagcgtttcctcatgcagttggtttcaggaaaaatacttgtttataggctgcatccttttttcagcccaacatttagctttatggagtgccaaagggaaaatatatccatatccctacaacttggtactctatcagattccagccactagaagaacctcagtgagaaaacacacccgcctttccctgttcccttctaagcacgnttgggaaggaacagnctnaagatgctntgtaaagctgtattttacccttgagcttagccgcgggnncctgtgaaccggcacattcctttcctttaggccgtccagagctctagtccacacccaatactttagagatctgggtttggggttagtagcttttttatttttttttcaattgagacagggtgggcctctgttgcccaagcttgagggcagtggtgcaatcataactcattgcagcctcgaacctcctgggcttaagggatccttctacctcagtctcccaggtagcaggaactataggcatgtgccaccatgcccagctaatatgacatttttggtgacagcacaaggtcttgctgtgttgttcaggctggtctcaaactcctggcctcaagcaatccttctgcctcagcttcccaaagtgttgggattataggcgtggccaagtttttctaatttttaaaaagctggctatctgcatttatagaaatagtgtgtagcagagatcagcagactttttatgtaatagaccaaacactaaatatgctttgcaggccatacaatctgccacagttacacagttctgctcttgtagcaggaaagcagacatagacaatatataatgaatggcctagctatgttctgaaaaaaccttgtttacaaaaacatgtgaagagctagatttgggccccaggacatagtctgctcacccttgatctgaaccacagattgaaatttggtgggcagaatggtccacaggtggtcaggcatggtggctgatgcctgtaatactagcacttcaggaggccagggtnggaggatcacttgagcccaggagtttgagaccagccttggcaacattgtgagactccatctccacacacacacacacacaaacacacacacaaacacacactaactgggtttggtggtgtgcacctgtagtttttgctacttcaagaggctgaggctgaagtgggaggattgcttgaagtgggaggtcaaagctgcagttatcatgccactatactccaacctgggtgacagagtgagactgtctcaaaaaagaaaaaaagaatggtccacaagccacagtaaagaaccaagtgtataaaaatttagtgtgagagaattctgctctgattcacacagaaattcatacatatgttcctgccatctagagaagcctgtgtagctgggctactggaacagagccactgacctgccctgctgttctttgatgaactaaatgatgatgtgctatgggctttggaagaaagtggctgacagcagagttaggcaggcatttcagaaagtcattctggcacccttggaacttttatggagttttctgcagcaacagccctgtctggtacatcagttgacaactcaggtctccttgggtcttgcttgtcaggctttggcacttaagtggaaagaaaaagaataagcattaaggaaagcgagagcacagcagaatcaatttcatagtctctcatggtttctgccatgggagaaaaatgggcattatactgctcacaggcagaataaagactcactggaaacattgctaagctgccttctccagaagatgtcagcggggcagttgcgtcaattggcgttccctgaaccctgagcccagctttggggtactctttgcttcccacccgtgaagtgacagtgagcagaccctcaaccttctgctttctcccaccaaaatgagtgagttttttagtatactttctaataacaccattactctgtgactactctctaatagtgactcaaattctgttataagcttcctgaagaggagagtaggcatcttctaaaaagtaaaagaacagcattagaatgacagaattttggaattaacagttttgcgctataagaacagggagggttatcgtaggtataactaattaaatcttttttttttttttttgagatggagtctcactttttcgcctaggctggagtgcagtggcacggtcttggctcaccgcaacctctgcctcccgggttcaagggattctcctgcctcagcctcctgagtagctgggattacaggtgtgtgctgccacacctgggtaattttttgtatttttaatagagacgggatttcgccttgttggccaggctggtcttgaactcctgacctcaagtgatctgcctgcctcggcctcccaaagtgctggcattacaggcatgagccacccacacccagccaactaattatcttttataccagatcccactttttacttagtgctgttagcatagcagtttttataaacattcttcaggtaggacctgtttgccttgatatcaaagagatggaaggagttgctcacttttgttcccagccttctttctagaaatctgccttccttcttcctatcaaatgttagcggagcaccgtctcttctttagcngtcactgcttgccttgtacagtgaaggaagtctggtgagcagcagtccaggaactgcccacgggtaccctgggttgggggttttcctaggcctttacacagaccgcagaatttatccttgatatatgctgtcatgtggtttgggcatttactagcattgaacttatttgagtagacagcagtgtagtttcaacctgttttttataatgtgtaaatttggatgcttttataggtagaagccactcattcttcatctacccttttttcagtatctggcaccaattctgacccagtcatttgtgatccctggctcttgtgatatgctgaagatttccaggcagtttttgtggaacacctccccgtccagctctaatcaagcaccatataaacaagaaattgcctggtcaaatctgtgaggactgtattctgactgccaaagagatcaatactgacaccagaatggcagctactctcaagtcattaaaacttgtaagataccgagcattttgcagtccttctgcctttggtgcagtccgaagtgtgtcatactggaatgtgagcagcacacagcatgggggacaggaccctccagaacacattagcctctgccattctgccaaaaaagttaagaacatatgtagcaccttctcttctcggagaatcctgacaaccagcagtgcccacccaggtttggaattcagcaagacttcttcctctaaggccagtacattgcagctgggctcacccagggccacaggagttgatgaagaggacgtagaagtgtttgattcctttgaaaacatgcgagttttcctacagctaagaccagaataccgtgttcacagctataatgcatctgagacttctcagctcctgtctgtttcagaaggtgaactaattttgcacaaagtcagagttaatcaaaataatctccaggctcaagtcattgttgattatttgtgtaagctgagctctttgcctgcagagcagcatcctgtcttgctgggcagtaccagctttgctctgctctgccagctgagtgtgaagaagatacagctctttgatacccaagatctgatcaatgttttgaaagcttttgtcattttaggaatccctcactcccattcaatgctagatgtgtatgagaccaagtgttgccatcaggtatgggagatgaatatggatcagctccttttggtggctgatctctggaggtacttaggccgcaaagtacctaggtttttaaacattttttctagttatcttaatttgcactggaaggatctatccttgtctcagctagttcacttaatttatgttataggtgaaaatcgtcaggtatcccaggacctaatgcaaaaattggaatcattgatccttaaatatatagatttgatcaatttggaggaggttggtaccatctgtttggggttctttaaatcaagtactaatctctctgaatttgtcatgcggaaaattggagacttggcttgtgctaacattcagcatctgagtagtcgctccttagtgaatattgttaaaatgttccgtttcactcacgtggatcacatcaatttcatgaagcagattggagagatagctcctcagcgaattccttccctgggagttcaaggtgtcatgcacctgactctttactgctcggccttacgcttcctgaatgaaggagtaatgaatgcagtggctgcgtctttgcctcctagagtggcacactgtcgaagtaaagatgttgccaagattctgtggtcatttggaactctgaattataagccacccaatgcagaagaattttactccagcctgataagtgagattcacagaaagatgcctgaattcaaccagtacccagaacacctgcccacctgcctgctgggcctggcatttttggagtactttccagtagagttaattgatttcgctctcagtccagggtttgtcaggttagctcaggagagaactaagtttgacctccttaaggaactatataccctcgatggtacagttggcattgagtgtccagattacagaggcaatcgtcttagtactcaccttcagcaagaggggtctgaattgctgtggtatttagcagagaaggatatgaattcaaagcctgaattcttagaaactgtctttttactggagaccatgctgggggggccccagtacgtcaagcaccatatgattttgcctcatacccgatcttctgacttagaggtccagcttgatgttaacctgaagccattaccatttaatagagaagccacgccggctgaaaatgtagccaaattaaggcttgagcatgtgggagtcagccttacagatgatttgatgaataagttactaaaagggaaagcaagaggacatttccagggcaaaactgagtcagagcctgggcagcagcccatggagttggagaataaggcagctgtacctctggggggcttcctttgcaatgtagcagataaatcaggggccatggagatggctggcctgtgccccgcagcctgcatgcagaccccaagaatgaagctggctgttcagttcacaaacaggaaccagtattgctatggctccagggatctccttggactgcacaatatgaagaggcggcagctggctcggcttggctaccgtgtggtagagttatcctactgggaatggctcccactactgaaacgaactcgcttagaaaagttggcgtttcttcatgagaaagtattcacctctgctctctgaagggcatttaggggcatttctatggcaaagctataggtgtatactgtaccaggtgttgcaaaatgattataaaagccagaatgtaagtttggcgataaaatagtgtgttgaggagacttaattgtatccaaggcaggttagagctagtgtatgttactgtgaattgtaatgtagttggattgtacaaattactgcaaatgtatacatgttactcttagtaaataataaacatcttaatatgtcctacggtcaa

SEQ ID NO: 458781 - DNA, 8779 bp, Homo sapiens
  misc_feature (2785)..(2785): n is a, c, g, or t
  misc_feature (2800)..(2800): n is a, c, g, or t
  misc_feature (2803)..(2803): n is a, c, g, or t
  misc_feature (2812)..(2812): n is a, c, g, or t
  misc_feature (2850)..(2851): n is a, c, g, or t
  misc_feature (3603)..(3603): n is a, c, g, or t
  misc_feature (5223)..(5223): n is a, c, g, or t
  misc_feature (8474)..(8474): n is a, c, g, or t
  misc_feature (8531)..(8531): n is a, c, g, or t
  misc_feature (8591)..(8591): n is a, c, g, or t
  misc_feature (8650)..(8650): n is a, c, g, or t
  misc_feature (8660)..(8660): n is a, c, g, or t
  misc_feature (8664)..(8664): n is a, c, g, or t
  misc_feature (8712)..(8712): n is a, c, g, or t
  misc_feature (8735)..(8735): n is a, c, g, or t
tagcgggcagttggccggaagtggggctgtgaggctcggagtcgccggaggagccagtatctgtgtcgccgccgcccgcggcgtccccggtttggtgttgcggcgcccaccttcgggaggatcagctgcttctgatgcttggaagatatcctctcagccacaaagatggtaataaatctttgcctcccacagttcagaccaagaattcactgcaacaagatatcagctgatggttacgaagtagaaaatctcatctctgaagatctcacaaagagaagtcatggtttcaggacagagtatttcattaagccaccagtctatgtgacagtttcatttccctttaatgtggaaatctgtaggatcaacatagacctcacagctgggggaggtcagaacgtcactggcctggaaatgtacacatctgcctcatctagcagagtgtcttggaatacgccccagtgccggaccctgggcccagctgagccatctgtcccagacaaggaggcgttcaccttggtaggcaaagtcttactgaaaaaccagagccaagtggtgtttagccacaggggcttcaaggccaggcccccttttggcgcgatggaagccacactcccctcccctgctgttgtggcccaggagctctggaataaaggggctctttcccttagccacgtggcccacttaaggatctgtatcacccatgtgacaggcggcggtatcccttgtatcaagcggttggaagtgtggggtcagccggccaagacctgctcccaggaagtgatagacagcatcctgctggtcacctcagagaacctgcctcaggatgtggctctgcaggctccagccttgcccatggaaagtgactgtgaccctggggaccagcctgagagccagcaggctccctccagcctgcagaagctggccgagatcattcaggatgtgcctgaggagttcctggatcccatcaccctggagatcatgccttgtcccatgctgctgccctcaggcaaggtcatcgaccagagcacactggagaagtgtaaccgcagtgaagccacatggggccgagtgcccagtgaccctttcacgggggtagcttttactccgcactctcagcccctgcctcacccctccctcaaggcccggattgaccatttcctgctccagcactccatccctggctgccacctgcttgggagagcacagacggcattggcagtgatcccttcttccattgttctgccctctcagaaaaggaagatagagcaggctgaacatgtcccagacagtaactttggtgtaaatgcttcctgtttttctgccacaagccctttggtcttacccactacctcagagcacactgctaagaaaatgaaagccaccaatgagcccagcctgacacatatggactgctcgacaggtccactgtcccacgagcagaagctgtcacaaagcttggaaattgccttggcatccacccttggctctatgccctccttcacggcacggctgaccaggggacagctccagcaccttggcacaagagggagcaacacttcctggaggcctggcaccggctcggagcagcctgggagcatcctgggccccgaatgtgcctcctgcaaaagagtattttctccctacttcaaaaaggagccggtgtaccagctgcctgcggccacctcctgtgccgaccctgcctgggtgagaagcaacgctccctgcccatgacgtgcacagcctgccagcggccggttgctagccaagacgtgctgcgggtccacttctgagtgactgacctccactggaggagacccattgctgggaggagctgagggggaacaggagcagggccacagcacccctgaggtctggccaggccccaggcacagagctgcctgctccctcccggggctcttcttcatcacctcacggtatagcacattgcttctgcgctggtggcaatagggcaacaaagccataggccagagggcggggggatgtccctgcctccctgccaccccccctgcctgagcccaggacccactggagccagccccaccctaggcaggaagacccctgctgagggcccccccgtgcagtccgcatacccccctgtccagcagggcactgtgggtggctcaccctagattgtggcccagatctcaggagtctctgccttcagggtcatccaaaagtggaccttgggagcagtgggggtgtctgtggagtgcatgactcagccccccgactcgcagccttaataaagcgatggttgacgtctgctgtgggtttcctcctggtggagtgcctgtctgtgtcacacactcctgtcgcccacctgcacccacacaagtggagctcacagggtagctgtgtgcagtcactgcagcttgccaggctgtcattcctgtcgatgacctgaaaggacacaaactggaattttcaggtctgtcccctgcatggggactcagaacccaggtttgcaggtgggcatacgtggtgggagggtggagggctccctctggccagtgccagctgtgctcagctggcttcagaaactgctccctgagggggagcgcagcgtttcctcatgcagttggtttcaggaaaaatacttgtttataggctgcatccttttttcagcccaacatttagctttatggagtgccaaagggaaaatatatccatatccctacaacttggtactctatcagattccagccactagaagaacctcagtgagaaaacacacccgcctttccctgttcccttctaagcacgnttgggaaggaacagnctnaagatgctntgtaaagctgtattttacccttgagcttagccgcgggnncctgtgaaccggcacattcctttcctttaggccgtccagagctctagtccacacccaatactttagagatctgggtttggggttagtagcttttttatttttttttcaattgagacagggtgggcctctgttgcccaagcttgagggcagtggtgcaatcataactcattgcagcctcgaacctcctgggcttaagggatccttctacctcagtctcccaggtagcaggaactataggcatgtgccaccatgcccagctaatatgacatttttggtgacagcacaaggtcttgctgtgttgttcaggctggtctcaaactcctggcctcaagcaatccttctgcctcagcttcccaaagtgttgggattataggcgtggccaagtttttctaatttttaaaaagctggctatctgcatttatagaaatagtgtgtagcagagatcagcagactttttatgtaatagaccaaacactaaatatgctttgcaggccatacaatctgccacagttacacagttctgctcttgtagcaggaaagcagacatagacaatatataatgaatggcctagctatgttctgaaaaaaccttgtttacaaaaacatgtgaagagctagatttgggccccaggacatagtctgctcacccttgatctgaaccacagattgaaatttggtgggcagaatggtccacaggtggtcaggcatggtggctgatgcctgtaatactagcacttcaggaggccagggtnggaggatcacttgagcccaggagtttgagaccagccttggcaacattgtgagactccatctccacacacacacacacacaaacacacacacaaacacacactaactgggtttggtggtgtgcacctgtagtttttgctacttcaagaggctgaggctgaagtgggaggattgcttgaagtgggaggtcaaagctgcagttatcatgccactatactccaacctgggtgacagagtgagactgtctcaaaaaagaaaaaaagaatggtccacaagccacagtaaagaaccaagtgtataaaaatttagtgtgagagaattctgctctgattcacacagaaattcatacatatgttcctgccatctagagaagcctgtgtagctgggctactggaacagagccactgacctgccctgctgttctttgatgaactaaatgatgatgtgctatgggctttggaagaaagtggctgacagcagagttaggcaggcatttcagaaagtcattctggcacccttggaacttttatggagttttctgcagcaacagccctgtctggtacatcagttgacaactcaggtctccttgggtcttgcttgtcaggctttggcacttaagtggaaagaaaaagaataagcattaaggaaagcgagagcacagcagaatcaatttcatagtctctcatggtttctgccatgggagaaaaatgggcattatactgctcacaggcagaataaagactcactggaaacattgctaagctgccttctccagaagatgtcagcggggcagttgcgtcaattggcgttccctgaaccctgagcccagctttggggtactctttgcttcccacccgtgaagtgacagtgagcagaccctcaaccttctgctttctcccaccaaaatgagtgagttttttagtatactttctaataacaccattactctgtgactactctctaatagtgactcaaattctgttataagcttcctgaagaggagagtaggcatcttctaaaaagtaaaagaacagcattagaatgacagaattttggaattaacagttttgcgctataagaacagggagggttatcgtaggtataactaattaaatcttttttttttttttttgagatggagtctcactttttcgcctaggctggagtgcagtggcacggtcttggctcaccgcaacctctgcctcccgggttcaagggattctcctgcctcagcctcctgagtagctgggattacaggtgtgtgctgccacacctgggtaattttttgtatttttaatagagacgggatttcgccttgttggccaggctggtcttgaactcctgacctcaagtgatctgcctgcctcggcctcccaaagtgctggcattacaggcatgagccacccacacccagccaactaattatcttttataccagatcccactttttacttagtgctgttagcatagcagtttttataaacattcttcaggtaggacctgtttgccttgatatcaaagagatggaaggagttgctcacttttgttcccagccttctttctagaaatctgccttccttcttcctatcaaatgttagcggagcaccgtctcttctttagcngtcactgcttgccttgtacagtgaaggaagtctggtgagcagcagtccaggaactgcccacgggtaccctgggttgggggttttcctaggcctttacacagaccgcagaatttatccttgatatatgctgtcatgtggtttgggcatttactagcattgaacttatttgagtagacagcagtgtagtttcaacctgttttttataatgtgtaaatttggatgcttttataggtagaagccactcattcttcatctacccttttttcagtatctggcaccaattctgacccagtcatttgtgatccctggctcttgtgatatgctgaagatttccaggcagtttttgtggaacacctccccgtccagctctaatcaagcaccatataaacaagaaattgcctggtcaaatctgtgaggactgtattctgactgccaaagagatcaatactgacaccagaatggcagctactctcaagtcattaaaacttgtaagataccgagcattttgcagtccttctgcctttggtgcagtccgaagtgtgtcatactggaatgtgagcagcacacagcatgggggacaggaccctccagaacacattagcctctgccattctgccaaaaaagttaagaacatatgtagcaccttctcttctcggagaatcctgacaaccagcagtgcccacccaggtttggaattcagcaagacttcttcctctaaggccagtacattgcagctgggctcacccagggccacaggagttgatgaagaggacgtagaagtgtttgattcctttgaaaacatgcgagttttcctacagctaagaccagaataccgtgttcacagctataatgcatctgagacttctcagctcctgtctgtttcagaaggtgaactaattttgcacaaagtcagagttaatcaaaataatctccaggctcaagtcattgttgattatttgtgtaagctgagctctttgcctgcagagcagcatcctgtcttgctgggcagtaccagctttgctctgctctgccagctgagtgtgaagaagatacagctctttgatacccaagatctgatcaatgttttgaaagcttttgtcattttaggaatccctcactcccattcaatgctagatgtgtatgagaccaagtgttgccatcaggtatgggagatgaatatggatcagctccttttggtggctgatctctggaggtacttaggccgcaaagtacctaggtttttaaacattttttctagttatcttaatttgcactggaaggatctatccttgtctcagctagttcacttaatttatgttataggtgaaaatcgtcaggtatcccaggacctaatgcaaaaattggaatcattgatccttaaatatatagatttgatcaatttggaggaggttggtaccatctgtttggggttctttaaatcaagtactaatctctctgaatttgtcatgcggaaaattggagacttggcttgtgctaacattcagcatctgagtagtcgctccttagtgaatattgttaaaatgttccgtttcactcacgtggatcacatcaatttcatgaagcagattggagagatagctcctcagcgaattccttccctgggagttcaaggtgtcatgcacctgactctttactgctcggccttacgcttcctgaatgaaggagtaatgaatgcagtggctgcgtctttgcctcctagagtggcacactgtcgaagtaaagatgttgccaagattctgtggtcatttggaactctgaattataagccacccaatgcagaagaattttactccagcctgataagtgagattcacagaaagatgcctgaattcaaccagtacccagaacacctgcccacctgcctgctgggcctggcatttttggagtactttccagtagagttaattgatttcgctctcagtccagggtttgtcaggttagctcaggagagaactaagtttgacctccttaaggaactatataccctcgatggtacagttggcattgagtgtccagattacagaggcaatcgtcttagtactcaccttcagcaagaggggtctgaattgctgtggtatttagcagagaaggatatgaattcaaagcctgaattcttagaaactgtctttttactggagaccatgctgggggggccccagtacgtcaagcaccatatgattttgcctcatacccgatcttctgacttagaggtccagcttgatgttaacctgaagccattaccatttaatagagaagccacgccggctgaaaatgtagccaaattaaggcttgagcatgtgggagtcagccttacagatgatttgatgaataagttactaaaagggaaagcaagaggacatttccagggcaaaactgagtcagagcctgggcagcagcccatggagttggagaataaggcagctgtacctctggggggcttcctttgcaatgtagcagataaatcaggggccatggagatggctggcctgtgccccgcagcctgcatgcagaccccaagaatgaagctggctgttcagttcacaaacaggaaccagtattgctatggctccagggatctccttggactgcacaatatgaagaggcggcagctggctcggcttggctaccgtgtggtagagttatcctactgggaatggctcccactactgaaacgaactcgcttagaaaagttggcgtttcttcatgagaaagtattcacctctgctctctgaagggcatttaggggcatttctatggcaaagctataggtgtatactgtaccaggtgttgcaaaatgattataaaagccagaatgtaagtttggcgataaaatagtgtgttgaggagacttaattgtatccaaggcaggttagagctagtgtatgttactgtgaattgtaatgtagttggattgtacaaattactgcaaatgtatacatgttactcttagtaaataataaacatcttaatatgtcctacggtcaagtaagtccttgttggatttttctttctgtttaccagccttatgtcacagagtttttagaataaaagtatagtcagacattatataaagccaatttttaaaaattttattcttttctggagaccctccccccacccttacagattttttttttttttaaagccagtttttttgtttgttttttgagatggagtctcgctctgtcacccaggctggaatgcagtggcacaatctcagctcactgcancctccgcctcccagattcaaacaattctcctgctcatgcctgttatctcagcctttnggaggccaaagtgggaagattgcttgagtccaggagtttgagaccagcctggccaacatngtgagaccttgcctctgcaaaaaaataaaattagccaggcgtggtggtgtgcccccgcngtcctagctnctcnggaggctgggtgggaggatctgttgagcctgggaggttgaggctgcantgagctgagatgacaccactgtnctttagcctggatgacagagcaagaccctaactcaaaaaaaaaa

SEQ ID NO: 458782 - DNA, 8574 bp, Homo sapiens
  misc_feature (2785)..(2785): n is a, c, g, or t
  misc_feature (2800)..(2800): n is a, c, g, or t
  misc_feature (2803)..(2803): n is a, c, g, or t
  misc_feature (2812)..(2812): n is a, c, g, or t
  misc_feature (2850)..(2851): n is a, c, g, or t
  misc_feature (3603)..(3603): n is a, c, g, or t
  misc_feature (5223)..(5223): n is a, c, g, or t
tagcgggcagttggccggaagtggggctgtgaggctcggagtcgccggaggagccagtatctgtgtcgccgccgcccgcggcgtccccggtttggtgttgcggcgcccaccttcgggaggatcagctgcttctgatgcttggaagatatcctctcagccacaaagatggtaataaatctttgcctcccacagttcagaccaagaattcactgcaacaagatatcagctgatggttacgaagtagaaaatctcatctctgaagatctcacaaagagaagtcatggtttcaggacagagtatttcattaagccaccagtctatgtgacagtttcatttccctttaatgtggaaatctgtaggatcaacatagacctcacagctgggggaggtcagaacgtcactggcctggaaatgtacacatctgcctcatctagcagagtgtcttggaatacgccccagtgccggaccctgggcccagctgagccatctgtcccagacaaggaggcgttcaccttggtaggcaaagtcttactgaaaaaccagagccaagtggtgtttagccacaggggcttcaaggccaggcccccttttggcgcgatggaagccacactcccctcccctgctgttgtggcccaggagctctggaataaaggggctctttcccttagccacgtggcccacttaaggatctgtatcacccatgtgacaggcggcggtatcccttgtatcaagcggttggaagtgtggggtcagccggccaagacctgctcccaggaagtgatagacagcatcctgctggtcacctcagagaacctgcctcaggatgtggctctgcaggctccagccttgcccatggaaagtgactgtgaccctggggaccagcctgagagccagcaggctccctccagcctgcagaagctggccgagatcattcaggatgtgcctgaggagttcctggatcccatcaccctggagatcatgccttgtcccatgctgctgccctcaggcaaggtcatcgaccagagcacactggagaagtgtaaccgcagtgaagccacatggggccgagtgcccagtgaccctttcacgggggtagcttttactccgcactctcagcccctgcctcacccctccctcaaggcccggattgaccatttcctgctccagcactccatccctggctgccacctgcttgggagagcacagacggcattggcagtgatcccttcttccattgttctgccctctcagaaaaggaagatagagcaggctgaacatgtcccagacagtaactttggtgtaaatgcttcctgtttttctgccacaagccctttggtcttacccactacctcagagcacactgctaagaaaatgaaagccaccaatgagcccagcctgacacatatggactgctcgacaggtccactgtcccacgagcagaagctgtcacaaagcttggaaattgccttggcatccacccttggctctatgccctccttcacggcacggctgaccaggggacagctccagcaccttggcacaagagggagcaacacttcctggaggcctggcaccggctcggagcagcctgggagcatcctgggccccgaatgtgcctcctgcaaaagagtattttctccctacttcaaaaaggagccggtgtaccagctgcctgcggccacctcctgtgccgaccctgcctgggtgagaagcaacgctccctgcccatgacgtgcacagcctgccagcggccggttgctagccaagacgtgctgcgggtccacttctgagtgactgacctccactggaggagacccattgctgggaggagctgagggggaacaggagcagggccacagcacccctgaggtctggccaggccccaggcacagagctgcctgctccctcccggggctcttcttcatcacctcacggtatagcacattgcttctgcgctggtggcaatagggcaacaaagccataggccagagggcggggggatgtccctgcctccctgccaccccccctgcctgagcccaggacccactggagccagccccaccctaggcaggaagacccctgctgagggcccccccgtgcagtccgcatacccccctgtccagcagggcactgtgggtggctcaccctagattgtggcccagatctcaggagtctctgccttcagggtcatccaaaagtggaccttgggagcagtgggggtgtctgtggagtgcatgactcagccccccgactcgcagccttaataaagcgatggttgacgtctgctgtgggtttcctcctggtggagtgcctgtctgtgtcacacactcctgtcgcccacctgcacccacacaagtggagctcacagggtagctgtgtgcagtcactgcagcttgccaggctgtcattcctgtcgatgacctgaaaggacacaaactggaattttcaggtctgtcccctgcatggggactcagaacccaggtttgcaggtgggcatacgtggtgggagggtggagggctccctctggccagtgccagctgtgctcagctggcttcagaaactgctccctgagggggagcgcagcgtttcctcatgcagttggtttcaggaaaaatacttgtttataggctgcatccttttttcagcccaacatttagctttatggagtgccaaagggaaaatatatccatatccctacaacttggtactctatcagattccagccactagaagaacctcagtgagaaaacacacccgcctttccctgttcccttctaagcacgnttgggaaggaacagnctnaagatgctntgtaaagctgtattttacccttgagcttagccgcgggnncctgtgaaccggcacattcctttcctttaggccgtccagagctctagtccacacccaatactttagagatctgggtttggggttagtagcttttttatttttttttcaattgagacagggtgggcctctgttgcccaagcttgagggcagtggtgcaatcataactcattgcagcctcgaacctcctgggcttaagggatccttctacctcagtctcccaggtagcaggaactataggcatgtgccaccatgcccagctaatatgacatttttggtgacagcacaaggtcttgctgtgttgttcaggctggtctcaaactcctggcctcaagcaatccttctgcctcagcttcccaaagtgttgggattataggcgtggccaagtttttctaatttttaaaaagctggctatctgcatttatagaaatagtgtgtagcagagatcagcagactttttatgtaatagaccaaacactaaatatgctttgcaggccatacaatctgccacagttacacagttctgctcttgtagcaggaaagcagacatagacaatatataatgaatggcctagctatgttctgaaaaaaccttgtttacaaaaacatgtgaagagctagatttgggccccaggacatagtctgctcacccttgatctgaaccacagattgaaatttggtgggcagaatggtccacaggtggtcaggcatggtggctgatgcctgtaatactagcacttcaggaggccagggtnggaggatcacttgagcccaggagtttgagaccagccttggcaacattgtgagactccatctccacacacacacacacacaaacacacacacaaacacacactaactgggtttggtggtgtgcacctgtagtttttgctacttcaagaggctgaggctgaagtgggaggattgcttgaagtgggaggtcaaagctgcagttatcatgccactatactccaacctgggtgacagagtgagactgtctcaaaaaagaaaaaaagaatggtccacaagccacagtaaagaaccaagtgtataaaaatttagtgtgagagaattctgctctgattcacacagaaattcatacatatgttcctgccatctagagaagcctgtgtagctgggctactggaacagagccactgacctgccctgctgttctttgatgaactaaatgatgatgtgctatgggctttggaagaaagtggctgacagcagagttaggcaggcatttcagaaagtcattctggcacccttggaacttttatggagttttctgcagcaacagccctgtctggtacatcagttgacaactcaggtctccttgggtcttgcttgtcaggctttggcacttaagtggaaagaaaaagaataagcattaaggaaagcgagagcacagcagaatcaatttcatagtctctcatggtttctgccatgggagaaaaatgggcattatactgctcacaggcagaataaagactcactggaaacattgctaagctgccttctccagaagatgtcagcggggcagttgcgtcaattggcgttccctgaaccctgagcccagctttggggtactctttgcttcccacccgtgaagtgacagtgagcagaccctcaaccttctgctttctcccaccaaaatgagtgagttttttagtatactttctaataacaccattactctgtgactactctctaatagtgactcaaattctgttataagcttcctgaagaggagagtaggcatcttctaaaaagtaaaagaacagcattagaatgacagaattttggaattaacagttttgcgctataagaacagggagggttatcgtaggtataactaattaaatcttttttttttttttttgagatggagtctcactttttcgcctaggctggagtgcagtggcacggtcttggctcaccgcaacctctgcctcccgggttcaagggattctcctgcctcagcctcctgagtagctgggattacaggtgtgtgctgccacacctgggtaattttttgtatttttaatagagacgggatttcgccttgttggccaggctggtcttgaactcctgacctcaagtgatctgcctgcctcggcctcccaaagtgctggcattacaggcatgagccacccacacccagccaactaattatcttttataccagatcccactttttacttagtgctgttagcatagcagtttttataaacattcttcaggtaggacctgtttgccttgatatcaaagagatggaaggagttgctcacttttgttcccagccttctttctagaaatctgccttccttcttcctatcaaatgttagcggagcaccgtctcttctttagcngtcactgcttgccttgtacagtgaaggaagtctggtgagcagcagtccaggaactgcccacgggtaccctgggttgggggttttcctaggcctttacacagaccgcagaatttatccttgatatatgctgtcatgtggtttgggcatttactagcattgaacttatttgagtagacagcagtgtagtttcaacctgttttttataatgtgtaaatttggatgcttttataggtagaagccactcattcttcatctacccttttttcagtatctggcaccaattctgacccagtcatttgtgatccctggctcttgtgatatgctgaagatttccaggcagtttttgtggaacacctccccgtccagctctaatcaagcaccatataaacaagaaattgcctggtcaaatctgtgaggactgtattctgactgccaaagagatcaatactgacaccagaatggcagctactctcaagtcattaaaacttgtaagataccgagcattttgcagtccttctgcctttggtgcagtccgaagtgtgtcatactggaatgtgagcagcacacagcatgggggacaggaccctccagaacacattagcctctgccattctgccaaaaaagttaagaacatatgtagcaccttctcttctcggagaatcctgacaaccagcagtgcccacccaggtttggaattcagcaagacttcttcctctaaggccagtacattgcagctgggctcacccagggccacaggagttgatgaagaggacgtagaagtgtttgattcctttgaaaacatgcgagttttcctacagctaagaccagaataccgtgttcacagctataatgcatctgagacttctcagctcctgtctgtttcagaaggtgaactaattttgcacaaagtcagagttaatcaaaataatctccaggctcaagtcattgttgattatttgtgtaagctgagctctttgcctgcagagcagcatcctgtcttgctgggcagtaccagctttgctctgctctgccagctgagtgtgaagaagatacagctctttgatacccaagatctgatcaatgttttgaaagcttttgtcattttaggaatccctcactcccattcaatgctagatgtgtatgagaccaagtgttgccatcaggtatgggagatgaatatggatcagctccttttggtggctgatctctggaggtacttaggccgcaaagtacctaggtttttaaacattttttctagttatcttaatttgcactggaaggatctatccttgtctcagctagttcacttaatttatgttataggtgaaaatcgtcaggtatcccaggacctaatgcaaaaattggaatcattgatccttaaatatatagatttgatcaatttggaggaggttggtaccatctgtttggggttctttaaatcaagtactaatctctctgaatttgtcatgcggaaaattggagacttggcttgtgctaacattcagcatctgagtagtcgctccttagtgaatattgttaaaatgttccgtttcactcacgtggatcacatcaatttcatgaagcagattggagagatagctcctcagcgaattccttccctgggagttcaaggtgtcatgcacctgactctttactgctcggccttacgcttcctgaatgaaggagtaatgaatgcagtggctgcgtctttgcctcctagagtggcacactgtcgaagtaaagatgttgccaagattctgtggtcatttggaactctgaattataagccacccaatgcagaagaattttactccagcctgataagtgagattcacagaaagatgcctgaattcaaccagtacccagaacacctgcccacctgcctgctgggcctggcatttttggagtactttccagtagagttaattgatttcgctctcagtccagggtttgtcaggttagctcaggagagaactaagtttgacctccttaaggaactatataccctcgatggtacagttggcattgagtgtccagattacagaggcaatcgtcttagtactcaccttcagcaagaggggtctgaattgctgtggtatttagcagagaaggatatgaattcaaagcctgaattcttagaaactgtctttttactggagaccatgctgggggggccccagtacgtcaagcaccatatgattttgcctcatacccgatcttctgacttagaggtccagcttgatgttaacctgaagccattaccatttaatagagaagccacgccggctgaaaatgtagccaaattaaggcttgagcatgtgggagtcagccttacagatgatttgatgaataagttactaaaagggaaagcaagaggacatttccagggcaaaactgagtcagagcctgggcagcagcccatggagttggagaataaggcagctgtacctctggggggcttcctttgcaatgtagcagataaatcaggggccatggagatggctggcctgtgccccgcagcctgcatgcagaccccaagaatgaagctggctgttcagttcacaaacaggaaccagtattgctatggctccagggatctccttggactgcacaatatgaagaggcggcagctggctcggcttggctaccgtgtggtagagttatcctactgggaatggctcccactactgaaacgaactcgcttagaaaagttggcgtttcttcatgagaaagtattcacctctgctctctgaagggcatttaggggcatttctatggcaaagctataggtgtatactgtaccaggtgttgcaaaatgattataaaagccagaatgtaagtttggcgataaaatagtgtgttgaggagacttaattgtatccaaggcaggttagagctagtgtatgttactgtgaattgtaatgtagttggattgtacaaattactgcaaatgtatacatgttactcttagtaaataataaacatcttaatatgtcctacggtcaaaaaaaaaaaaaaaaaaaaaaaaaaaaaaacaaaaaaaaaaacaagaacgaaaacatgaaacaaaaagaaaaaagaaacaaaaaaaaaagggggggcgggcggcggcaaaaaacgaaccacccctgcgggggggggcaaaaaagcatcagccacagcacactgtactatggcacaagagggcggccccccaacaagagggggcgctgaattatgaaaaagaggcgccgcggggcaggaaaaacaaaccacgtagatgggaaaacaaccaacaggcagacgaggcaacattggaggaacgcgcaaccactgggggggggaacaagaacgagcacacacccgcaaagt

SEQ ID NO: 458783 - DNA, 2286 bp, Homo sapiens
tagcgggcagttggccggaagtggggctgtgaggctcggagtcgccggaggagccagtatctgtgtcgccgccgcccgcggcgtccccggtttggtgttgcggcgcccaccttcgggaggatcagctgcttctgatgcttggaagatatcctctcagccacaaagatggtaataaatctttgcctcccacagttcagaccaagaattcactgcaacaagatatcagctgatggttacgaagtagaaaatctcatctctgaagatctcacaaagagaagtcatggtttcaggacagagtatttcattaagccaccagtctatgtgacagtttcatttccctttaatgtggaaatctgtaggatcaacatagacctcacagctgggggaggtcagaacgtcactggcctggaaatgtacacatctgcctcatctagcagagtgtcttggaatacgccccagtgccggaccctgggcccagctgagccatctgtcccagacaaggaggcgttcaccttggtaggcaaagtcttactgaaaaaccagagccaagtggtgtttagccacaggggcttcaaggccaggcccccttttggcgcgatggaagccacactcccctcccctgctgttgtggcccaggagctctggaataaaggggctctttcccttagccacgtggcccacttaaggatctgtatcacccatgtgacaggcggcggtatcccttgtatcaagcggttggaagtgtggggtcagccggccaagacctgctcccaggaagtgatagacagcatcctgctggtcacctcagagaacctgcctcaggatgtggctctgcaggctccagccttgcccatggaaagtgactgtgaccctggggaccagcctgagagccagcaggctccctccagcctgcagaagctggccgagatcattcaggatgtgcctgaggagttcctggatcccatcaccctggagatcatgccttgtcccatgctgctgccctcaggcaaggtcatcgaccagagcacactggagaagtgtaaccgcagtgaagccacatggggccgagtgcccagtgaccctttcacgggggtagcttttactccgcactctcagcccctgcctcacccctccctcaaggcccggattgaccatttcctgctccagcactccatccctggctgccacctgcttgggagagcacagacggcattggcagtgatcccttcttccattgttctgccctctcagaaaaggaagatagagcaggctgaacatgtcccagacagtaactttggtgtaaatgcttcctgtttttctgccacaagccctttggtcttacccactacctcagagcacactgctaagaaaatgaaagccaccaatgagcccagcctgacacatatggactgctcgacaggtccactgtcccacgagcagaagctgtcacaaagcttggaaattgccttggcatccacccttggctctatgccctccttcacggcacggctgaccaggggacagctccagcaccttggcacaagagggagcaacacttcctggaggcctggcaccggctcggagcagcctgggagcatcctgggccccgaatgtgcctcctgcaaaagagtattttctccctacttcaaaaaggagccggtgtaccagctgcctgcggccacctcctgtgccgaccctgcctgggtgagaagcaacgctccctgcccatgacgtgcacagcctgccagcggccggttgctagccaagacgtgctgcgggtccacttctgagtgactgacctccactggaggagacccattgctgggaggagctgagggggaacaggagcagggccacagcacccctgaggtctggccaggccccaggcacagagctgcctgctccctcccggggctcttcttcatcacctcacggtatagcacattgcttctgcgctggtggcaatagggcaacaaagccataggccagagggcggggggatgtccctgcctccctgccaccccccctgcctgagcccaggacccactggagccagccccaccctaggcaggaagacccctgctgagggcccccccgtgcagtccgcatacccccctgtccagcagggcactgtgggtggctcaccctagattgtggcccagatctcaggagtctctgccttcagggtcatccaaaagtggaccttgggagcagtgggggtgtctgtggagtgcatgactcagccccccgactcgcagccttaataaagcgatggttgacgtctgc

SEQ ID NO: 458784 - DNA, 3360 bp, Homo sapiens
  misc_feature (3055)..(3055): n is a, c, g, or t
  misc_feature (3112)..(3112): n is a, c, g, or t
  misc_feature (3172)..(3172): n is a, c, g, or t
  misc_feature (3231)..(3231): n is a, c, g, or t
  misc_feature (3241)..(3241): n is a, c, g, or t
  misc_feature (3245)..(3245): n is a, c, g, or t
  misc_feature (3293)..(3293): n is a, c, g, or t
  misc_feature (3316)..(3316): n is a, c, g, or t
tagcgggcagttggccggaagtggggctgtgaggctcggagtcgccggaggagccagtatctgtgtcgccgccgcccgcggcgtccccggtttggtgttgcggcgcccaccttcgggaggatcagtatctggcaccaattctgacccagtcatttgtgatccctggctcttgtgatatgctgaagatttccaggcagtttttgtggaacacctccccgtccagctctaatcaagcaccatataaacaagaaattgcctggtcaaatctgtgaggactgtattctgactgccaaagagatcaatactgacaccagaatggcagctactctcaagtcattaaaatgtgtcatactggaatgtgagcagcacacagcatgggggacaggaccctccagaacacattagcctctgccattctgccaaaaaagttaagaacatatgtagcaccttctcttctcggagaatcctgacaaccagcagtgcccacccaggtttggaattcagcaagacttcttcctctaaggccagtacattgcagctgggctcacccagggccacaggagttgatgaagaggacgtagaagtgtttgattcctttgaaaacatgcgagttttcctacagctaagaccagaataccgtgttcacagctataatgcatctgagacttctcagctcctgtctgtttcagaaggtgaactaattttgcacaaagtcagagttaatcaaaataatctccaggctcaagtcattgttgattatttgtgtaagctgagctctttgcctgcagagcagcatcctgtcttgctgggcagtaccagctttgctctgctctgccagctgagtgtgaagaagatacagctctttgatacccaagatctgatcaatgttttgaaagcttttgtcattttaggaatccctcactcccattcaatgctagatgtgtatgagaccaagtgttgccatcaggtatgggagatgaatatggatcagctccttttggtggctgatctctggaggtacttaggccgcaaagtacctaggtttttaaacattttttctagttatcttaatttgcactggaaggatctatccttgtctcagctagttcacttaatttatgttataggtgaaaatcgtcaggtatcccaggacctaatgcaaaaattggaatcattgatccttaaatatatagatttgatcaatttggaggaggttggtaccatctgtttggggttctttaaatcaagtactaatctctctgaatttgtcatgcggaaaattggagacttggcttgtgctaacattcagcatctgagtagtcgctccttagtgaatattgttaaaatgttccgtttcactcacgtggatcacatcaatttcatgaagcagattggagagatagctcctcagcgaattccttccctgggagttcaaggtgtcatgcacctgactctttactgctcggccttacgcttcctgaatgaaggagtaatgaatgcagtggctgcgtctttgcctcctagagtggcacactgtcgaagtaaagatgttgccaagattctgtggtcatttggaactctgaattataagccacccaatgcagaagaattttactccagcctgataagtgagattcacagaaagatgcctgaattcaaccagtacccagaacacctgcccacctgcctgctgggcctggcatttttggagtactttccagtagagttaattgatttcgctctcagtccagggtttgtcaggttagctcaggagagaactaagtttgacctccttaaggaactatataccctcgatggtacagttggcattgagtgtccagattacagaggcaatcgtcttagtactcaccttcagcaagaggggtctgaattgctgtggtatttagcagagaaggatatgaattcaaagcctgaattcttagaaactgtctttttactggagaccatgctgggggggccccagtacgtcaagcaccatatgattttgcctcatacccgatcttctgacttagaggtccagcttgatgttaacctgaagccattaccatttaatagagaagccacgccggctgaaaatgtagccaaattaaggcttgagcatgtgggagtcagccttacagatgatttgatgaataagttactaaaagggaaagcaagaggacatttccagggcaaaactgagtcagagcctgggcagcagcccatggagttggagaataaggcagctgtacctctggggggcttcctttgcaatgtagcagataaatcaggggccatggagatggctggcctgtgccccgcagcctgcatgcagaccccaagaatgaagctggctgttcagttcacaaacaggaaccagtattgctatggctccagggatctccttggactgcacaatatgaagaggcggcagctggctcggcttggctaccgtgtggtagagttatcctactgggaatggctcccactactgaaacgaactcgcttagaaaagttggcgtttcttcatgagaaagtattcacctctgctctctgaagggcatttaggggcatttctatggcaaagctataggtgtatactgtaccaggtgttgcaaaatgattataaaagccagaatgtaagtttggcgataaaatagtgtgttgaggagacttaattgtatccaaggcaggttagagctagtgtatgttactgtgaattgtaatgtagttggattgtacaaattactgcaaatgtatacatgttactcttagtaaataataaacatcttaatatgtcctacggtcaagtaagtccttgttggatttttctttctgtttaccagccttatgtcacagagtttttagaataaaagtatagtcagacattatataaagccaatttttaaaaattttattcttttctggagaccctccccccacccttacagattttttttttttttaaagccagtttttttgtttgttttttgagatggagtctcgctctgtcacccaggctggaatgcagtggcacaatctcagctcactgcancctccgcctcccagattcaaacaattctcctgctcatgcctgttatctcagcctttnggaggccaaagtgggaagattgcttgagtccaggagtttgagaccagcctggccaacatngtgagaccttgcctctgcaaaaaaataaaattagccaggcgtggtggtgtgcccccgcngtcctagctnctcnggaggctgggtgggaggatctgttgagcctgggaggttgaggctgcantgagctgagatgacaccactgtnctttagcctggatgacagagcaagaccctaactcaaaaaaaaaa

SEQ ID NO: 458785 - DNA, 7959 bp, Homo sapiens
  misc_feature (2785)..(2785): n is a, c, g, or t
  misc_feature (2800)..(2800): n is a, c, g, or t
  misc_feature (2803)..(2803): n is a, c, g, or t
  misc_feature (2812)..(2812): n is a, c, g, or t
  misc_feature (2850)..(2851): n is a, c, g, or t
  misc_feature (3603)..(3603): n is a, c, g, or t
  misc_feature (5223)..(5223): n is a, c, g, or t
tagcgggcagttggccggaagtggggctgtgaggctcggagtcgccggaggagccagtatctgtgtcgccgccgcccgcggcgtccccggtttggtgttgcggcgcccaccttcgggaggatcagctgcttctgatgcttggaagatatcctctcagccacaaagatggtaataaatctttgcctcccacagttcagaccaagaattcactgcaacaagatatcagctgatggttacgaagtagaaaatctcatctctgaagatctcacaaagagaagtcatggtttcaggacagagtatttcattaagccaccagtctatgtgacagtttcatttccctttaatgtggaaatctgtaggatcaacatagacctcacagctgggggaggtcagaacgtcactggcctggaaatgtacacatctgcctcatctagcagagtgtcttggaatacgccccagtgccggaccctgggcccagctgagccatctgtcccagacaaggaggcgttcaccttggtaggcaaagtcttactgaaaaaccagagccaagtggtgtttagccacaggggcttcaaggccaggcccccttttggcgcgatggaagccacactcccctcccctgctgttgtggcccaggagctctggaataaaggggctctttcccttagccacgtggcccacttaaggatctgtatcacccatgtgacaggcggcggtatcccttgtatcaagcggttggaagtgtggggtcagccggccaagacctgctcccaggaagtgatagacagcatcctgctggtcacctcagagaacctgcctcaggatgtggctctgcaggctccagccttgcccatggaaagtgactgtgaccctggggaccagcctgagagccagcaggctccctccagcctgcagaagctggccgagatcattcaggatgtgcctgaggagttcctggatcccatcaccctggagatcatgccttgtcccatgctgctgccctcaggcaaggtcatcgaccagagcacactggagaagtgtaaccgcagtgaagccacatggggccgagtgcccagtgaccctttcacgggggtagcttttactccgcactctcagcccctgcctcacccctccctcaaggcccggattgaccatttcctgctccagcactccatccctggctgccacctgcttgggagagcacagacggcattggcagtgatcccttcttccattgttctgccctctcagaaaaggaagatagagcaggctgaacatgtcccagacagtaactttggtgtaaatgcttcctgtttttctgccacaagccctttggtcttacccactacctcagagcacactgctaagaaaatgaaagccaccaatgagcccagcctgacacatatggactgctcgacaggtccactgtcccacgagcagaagctgtcacaaagcttggaaattgccttggcatccacccttggctctatgccctccttcacggcacggctgaccaggggacagctccagcaccttggcacaagagggagcaacacttcctggaggcctggcaccggctcggagcagcctgggagcatcctgggccccgaatgtgcctcctgcaaaagagtattttctccctacttcaaaaaggagccggtgtaccagctgcctgcggccacctcctgtgccgaccctgcctgggtgagaagcaacgctccctgcccatgacgtgcacagcctgccagcggccggttgctagccaagacgtgctgcgggtccacttctgagtgactgacctccactggaggagacccattgctgggaggagctgagggggaacaggagcagggccacagcacccctgaggtctggccaggccccaggcacagagctgcctgctccctcccggggctcttcttcatcacctcacggtatagcacattgcttctgcgctggtggcaatagggcaacaaagccataggccagagggcggggggatgtccctgcctccctgccaccccccctgcctgagcccaggacccactggagccagccccaccctaggcaggaagacccctgctgagggcccccccgtgcagtccgcatacccccctgtccagcagggcactgtgggtggctcaccctagattgtggcccagatctcaggagtctctgccttcagggtcatccaaaagtggaccttgggagcagtgggggtgtctgtggagtgcatgactcagccccccgactcgcagccttaataaagcgatggttgacgtctgctgtgggtttcctcctggtggagtgcctgtctgtgtcacacactcctgtcgcccacctgcacccacacaagtggagctcacagggtagctgtgtgcagtcactgcagcttgccaggctgtcattcctgtcgatgacctgaaaggacacaaactggaattttcaggtctgtcccctgcatggggactcagaacccaggtttgcaggtgggcatacgtggtgggagggtggagggctccctctggccagtgccagctgtgctcagctggcttcagaaactgctccctgagggggagcgcagcgtttcctcatgcagttggtttcaggaaaaatacttgtttataggctgcatccttttttcagcccaacatttagctttatggagtgccaaagggaaaatatatccatatccctacaacttggtactctatcagattccagccactagaagaacctcagtgagaaaacacacccgcctttccctgttcccttctaagcacgnttgggaaggaacagnctnaagatgctntgtaaagctgtattttacccttgagcttagccgcgggnncctgtgaaccggcacattcctttcctttaggccgtccagagctctagtccacacccaatactttagagatctgggtttggggttagtagcttttttatttttttttcaattgagacagggtgggcctctgttgcccaagcttgagggcagtggtgcaatcataactcattgcagcctcgaacctcctgggcttaagggatccttctacctcagtctcccaggtagcaggaactataggcatgtgccaccatgcccagctaatatgacatttttggtgacagcacaaggtcttgctgtgttgttcaggctggtctcaaactcctggcctcaagcaatccttctgcctcagcttcccaaagtgttgggattataggcgtggccaagtttttctaatttttaaaaagctggctatctgcatttatagaaatagtgtgtagcagagatcagcagactttttatgtaatagaccaaacactaaatatgctttgcaggccatacaatctgccacagttacacagttctgctcttgtagcaggaaagcagacatagacaatatataatgaatggcctagctatgttctgaaaaaaccttgtttacaaaaacatgtgaagagctagatttgggccccaggacatagtctgctcacccttgatctgaaccacagattgaaatttggtgggcagaatggtccacaggtggtcaggcatggtggctgatgcctgtaatactagcacttcaggaggccagggtnggaggatcacttgagcccaggagtttgagaccagccttggcaacattgtgagactccatctccacacacacacacacacaaacacacacacaaacacacactaactgggtttggtggtgtgcacctgtagtttttgctacttcaagaggctgaggctgaagtgggaggattgcttgaagtgggaggtcaaagctgcagttatcatgccactatactccaacctgggtgacagagtgagactgtctcaaaaaagaaaaaaagaatggtccacaagccacagtaaagaaccaagtgtataaaaatttagtgtgagagaattctgctctgattcacacagaaattcatacatatgttcctgccatctagagaagcctgtgtagctgggctactggaacagagccactgacctgccctgctgttctttgatgaactaaatgatgatgtgctatgggctttggaagaaagtggctgacagcagagttaggcaggcatttcagaaagtcattctggcacccttggaacttttatggagttttctgcagcaacagccctgtctggtacatcagttgacaactcaggtctccttgggtcttgcttgtcaggctttggcacttaagtggaaagaaaaagaataagcattaaggaaagcgagagcacagcagaatcaatttcatagtctctcatggtttctgccatgggagaaaaatgggcattatactgctcacaggcagaataaagactcactggaaacattgctaagctgccttctccagaagatgtcagcggggcagttgcgtcaattggcgttccctgaaccctgagcccagctttggggtactctttgcttcccacccgtgaagtgacagtgagcagaccctcaaccttctgctttctcccaccaaaatgagtgagttttttagtatactttctaataacaccattactctgtgactactctctaatagtgactcaaattctgttataagcttcctgaagaggagagtaggcatcttctaaaaagtaaaagaacagcattagaatgacagaattttggaattaacagttttgcgctataagaacagggagggttatcgtaggtataactaattaaatcttttttttttttttttgagatggagtctcactttttcgcctaggctggagtgcagtggcacggtcttggctcaccgcaacctctgcctcccgggttcaagggattctcctgcctcagcctcctgagtagctgggattacaggtgtgtgctgccacacctgggtaattttttgtatttttaatagagacgggatttcgccttgttggccaggctggtcttgaactcctgacctcaagtgatctgcctgcctcggcctcccaaagtgctggcattacaggcatgagccacccacacccagccaactaattatcttttataccagatcccactttttacttagtgctgttagcatagcagtttttataaacattcttcaggtaggacctgtttgccttgatatcaaagagatggaaggagttgctcacttttgttcccagccttctttctagaaatctgccttccttcttcctatcaaatgttagcggagcaccgtctcttctttagcngtcactgcttgccttgtacagtgaaggaagtctggtgagcagcagtccaggaactgcccacgggtaccctgggttgggggttttcctaggcctttacacagaccgcagaatttatccttgatatatgctgtcatgtggtttgggcatttactagcattgaacttatttgagtagacagcagtgtagtttcaacctgttttttataatgtgtaaatttggatgcttttataggtagaagccactcattcttcatctacccttttttcagtatctggcaccaattctgacccagtcatttgtgatccctggctcttgtgatatgctgaagatttccaggcagtttttgtggaacacctccccgtccagctctaatcaagcaccatataaacaagaaattgcctggtcaaatctgtgaggactgtattctgactgccaaagagatcaatactgacaccagaatggcagctactctcaagtcattaaaacttgtaagataccgagcattttgcagtccttctgcctttggtgcagtccgaagtgtgtcatactggaatgtgagcagcacacagcatgggggacaggaccctccagaacacattagcctctgccattctgccaaaaaagttaagaacatatgtagcaccttctcttctcggagaatcctgacaaccagcagtgcccacccaggtttggaattcagcaagacttcttcctctaaggccagtacattgcagctgggctcacccagggccacaggagttgatgaagaggacgtagaagtgtttgattcctttgaaaacatgcgagttttcctacagctaagaccagaataccgtgttcacagctataatgcatctgagacttctcagctcctgtctgtttcagaaggtgaactaattttgcacaaagtcagagttaatcaaaataatctccaggctcaagtcattgttgattatttgtgtaagctgagctctttgcctgcagagcagcatcctgtcttgctgggcagtaccagctttgctctgctctgccagctgagtgtgaagaagatacagctctttgatacccaagatctgatcaatgttttgaaagcttttgtcattttaggaatccctcactcccattcaatgctagatgtgtatgagaccaagtgttgccatcaggtatgggagatgaatatggatcagctccttttggtggctgatctctggaggtacttaggccgcaaagtacctaggtttttaaacattttttctagttatcttaatttgcactggaaggatctatccttgtctcagctagttcacttaatttatgttataggtgaaaatcgtcaggtatcccaggacctaatgcaaaaattggaatcattgatccttaaatatatagatttgatcaatttggaggaggttggtaccatctgtttggggttctttaaatcaagtactaatctctctgaatttgtcatgcggaaaattggagacttggcttgtgctaacattcagcatctgagtagtcgctccttagtgaatattgttaaaatgttccgtttcactcacgtggatcacatcaatttcatgaagcagattggagagatagctcctcagcgaattccttccctgggagttcaaggtgtcatgcacctgactctttactgctcggccttacgcttcctgaatgaaggagtaatgaatgcagtggctgcgtctttgcctcctagagtggcacactgtcgaagtaaagatgttgccaagattctgtggtcatttggaactctgaattataagccacccaatgcagaagaattttactccagcctgataagtgagattcacagaaagatgcctgaattcaaccagtacccagaacacctgcccacctgcctgctgggcctggcatttttggagtactttccagtagagttaattgatttcgctctcagtccagggtttgtcaggttagctcaggagagaactaagtttgacctccttaaggaactatataccctcgatggtacagttggcattgagtgtccagattacagaggcaatcgtcttagtactcaccttcagcaagaggggtctgaattgctgtggtatttagcagagaaggatatgaattcaaagcctgaattcttagaaactgtctttttactggagaccatgctgggggggccccagtacgtcaagcaccatatgattttgcctcatacccgatcttctgacttagaggtccagcttgatgttaacctgaagccattaccatttaatagagaagccacgccggctgaaaatgtagccaaattaaggcttgagcatgtgggagtcagccttacagatgatttgatgaataagcggcagctggctcggcttggctaccgtgtggtagagttatcctactgggaatggctcccactactgaaacgaactcgcttagaaaagttggcgtttcttcatgagaaagtattcacctctgctctctgaagggcatttaggggcatttctatggcaaagctataggtgtatactgtaccaggtgttgcaaaatgattataaaagccagaatgtaagtttggcgataaaatagtgtgttgaggagacttaattgtatccaaggcaggttagagctagtgtatgttactgtgaattgtaatgtagttggattgtacaaattactgcaaatgtatacatgttactcttagtaaataataaacatcttaatatgtcctacggtcaa

SEQ ID NO: 458786 - DNA, 2863 bp, Homo sapiens
tagcgggcagttggccggaagtggggctgtgaggctcggagtcgccggaggagccagtatctgtgtcgccgccgcccgcggcgtccccggtttggtgttgcggcgcccaccttcgggaggatcagtatctggcaccaattctgacccagtcatttgtgatccctggctcttgtgatatgctgaagatttccaggcagtttttgtggaacacctccccgtccagctctaatcaagcaccatataaacaagaaattgcctggtcaaatctgtgaggactgtattctgactgccaaagagatcaatactgacaccagaatggcagctactctcaagtcattaaaacttgtaagataccgagcattttgcagtccttctgcctttggtgcagtccgaagtgtgtcatactggaatgtgagcagcacacagcatgggggacaggaccctccagaacacattagcctctgccattctgccaaaaaagttaagaacatatgtagcaccttctcttctcggagaatcctgacaaccagcagtgcccacccaggtttggaattcagcaagacttcttcctctaaggccagtacattgcagctgggctcacccagggccacaggagttgatgaagaggacgtagaagtgtttgattcctttgaaaacatgcgagttttcctacagctaagaccagaataccgtgttcacagctataatgcatctgagacttctcagctcctgtctgtttcagaaggtgaactaattttgcacaaagtcagagttaatcaaaataatctccaggctcaagtcattgttgattatttgtgtaagctgagctctttgcctgcagagcagcatcctgtcttgctgggcagtaccagctttgctctgctctgccagctgagtgtgaagaagatacagctctttgatacccaagatctgatcaatgttttgaaagcttttgtcattttaggaatccctcactcccattcaatgctagatgtgtatgagaccaagtgttgccatcaggtatgggagatgaatatggatcagctccttttggtggctgatctctggaggtacttaggccgcaaagtacctaggtttttaaacattttttctagttatcttaatttgcactggaaggatctatccttgtctcagctagttcacttaatttatgttataggtgaaaatcgtcaggtatcccaggacctaatgcaaaaattggaatcattgatccttaaatatatagatttgatcaatttggaggaggttggtaccatctgtttggggttctttaaatcaagtactaatctctctgaatttgtcatgcggaaaattggagacttggcttgtgctaacattcagcatctgagtagtcgctccttagtgaatattgttaaaatgttccgtttcactcacgtggatcacatcaatttcatgaagcagattggagagatagctcctcagcgaattccttccctgggagttcaaggtgtcatgcacctgactctttactgctcggccttacgcttcctgaatgaaggagtaatgaatgcagtggctgcgtctttgcctcctagagtggcacactgtcgaagtaaagatgttgccaagattctgtggtcatttggaactctgaattataagccacccaatgcagaagaattttactccagcctgataagtgagattcacagaaagatgcctgaattcaaccagtacccagaacacctgcccacctgcctgctgggcctggcatttttggagtactttccagtagagttaattgatttcgctctcagtccagggtttgtcaggttagctcaggagagaactaagtttgacctccttaaggaactatataccctcgatggtacagttggcattgagtgtccagattacagaggcaatcgtcttagtactcaccttcagcaagaggggtctgaattgctgtggtatttagcagagaaggatatgaattcaaagcctgaattcttagaaactgtctttttactggagaccatgctgggggggccccagtacgtcaagcaccatatgattttgcctcatacccgatcttctgacttagaggtccagcttgatgttaacctgaagccattaccatttaatagagaagccacgccggctgaaaatgtagccaaattaaggcttgagcatgtgggagtcagccttacagatgatttgatgaataagttactaaaagggaaagcaagaggacatttccagggcaaaactgagtcagagcctgggcagcagcccatggagttggagaataaggcagctgtacctctggggggcttcctttgcaatgtagcagataaatcaggggccatggagatggctggcctgtgccccgcagcctgcatgcagaccccaagaatgaagctggctgttcagttcacaaacaggaaccagtattgctatggctccagggatctccttggactgcacaatatgaagaggcggcagctggctcggcttggctaccgtgtggtagagttatcctactgggaatggctcccactactgaaacgaactcgcttagaaaagttggcgtttcttcatgagaaagtattcacctctgctctctgaagggcatttaggggcatttctatggcaaagctataggtgtatactgtaccaggtgttgcaaaatgattataaaagccagaatgtaagtttggcgataaaatagtgtgttgaggagacttaattgtatccaaggcaggttagagctagtgtatgttactgtgaattgtaatgtagttggattgtacaaattactgcaaatgtatacatgttactcttagtaaataataaacatcttaatatgtcctacggtcaa

SEQ ID NO: 458787 - DNA, 4935 bp, Homo sapiens
  misc_feature (19)..(19): n is a, c, g, or t
  misc_feature (1379)..(1379): n is a, c, g, or t
  misc_feature (4630)..(4630): n is a, c, g, or t
  misc_feature (4687)..(4687): n is a, c, g, or t
  misc_feature (4747)..(4747): n is a, c, g, or t
  misc_feature (4806)..(4806): n is a, c, g, or t
  misc_feature (4816)..(4816): n is a, c, g, or t
  misc_feature (4820)..(4820): n is a, c, g, or t
  misc_feature (4868)..(4868): n is a, c, g, or t
  misc_feature (4891)..(4891): n is a, c, g, or t
agtgatctagaggatccgnggactttccacgagtcacagtaaagaaccaagtgtataaaaatttagtgtgagagaattctgctctgattcacacagaaattcatacatatgttcctgccatctagagaagcctgtgtagctgggctactggaacagagccactgacctgccctgctgttctttgatgaactaaatgatgatgtgctatgggctttggaagaaagtggctgacagcagagttaggcaggcatttcagaaagtcattctggcacccttggaacttttatggagttttctgcagcaacagccctgtctggtacatcagttgacaactcaggtctccttgggtcttgcttgtcaggctttggcacttaagtggaaagaaaaagaataagcattaaggaaagcgagagcacagcagaatcaatttcatagtctctcatggtttctgccatgggagaaaaatgggcattatactgctcacaggcagaataaagactcactggaaacattgctaagctgccttctccagaagatgtcagcggggcagttgcgtcaattggcgttccctgaaccctgagcccagctttggggtactctttgcttcccacccgtgaagtgacagtgagcagaccctcaaccttctgctttctcccaccaaaatgagtgagttttttagtatactttctaataacaccattactctgtgactactctctaatagtgactcaaattctgttataagcttcctgaagaggagagtaggcatcttctaaaaagtaaaagaacagcattagaatgacagaattttggaattaacagttttgcgctataagaacagggagggttatcgtaggtataactaattaaatcttttttttttttttttgagatggagtctcactttttcgcctaggctggagtgcagtggcacggtcttggctcaccgcaacctctgcctcccgggttcaagggattctcctgcctcagcctcctgagtagctgggattacaggtgtgtgctgccacacctgggtaattttttgtatttttaatagagacgggatttcgccttgttggccaggctggtcttgaactcctgacctcaagtgatctgcctgcctcggcctcccaaagtgctggcattacaggcatgagccacccacacccagccaactaattatcttttataccagatcccactttttacttagtgctgttagcatagcagtttttataaacattcttcaggtaggacctgtttgccttgatatcaaagagatggaaggagttgctcacttttgttcccagccttctttctagaaatctgccttccttcttcctatcaaatgttagcggagcaccgtctcttctttagcngtcactgcttgccttgtacagtgaaggaagtctggtgagcagcagtccaggaactgcccacgggtaccctgggttgggggttttcctaggcctttacacagaccgcagaatttatccttgatatatgctgtcatgtggtttgggcatttactagcattgaacttatttgagtagacagcagtgtagtttcaacctgttttttataatgtgtaaatttggatgcttttataggtagaagccactcattcttcatctacccttttttcagtatctggcaccaattctgacccagtcatttgtgatccctggctcttgtgatatgctgaagatttccaggcagtttttgtggaacacctccccgtccagctctaatcaagcaccatataaacaagaaattgcctggtcaaatctgtgaggactgtattctgactgccaaagagatcaatactgacaccagaatggcagctactctcaagtcattaaaacttgtaagataccgagcattttgcagtccttctgcctttggtgcagtccgaagtgtgtcatactggaatgtgagcagcacacagcatgggggacaggaccctccagaacacattagcctctgccattctgccaaaaaagttaagaacatatgtagcaccttctcttctcggagaatcctgacaaccagcagtgcccacccaggtttggaattcagcaagacttcttcctctaaggccagtacattgcagctgggctcacccagggccacaggagttgatgaagaggacgtagaagtgtttgattcctttgaaaacatgcgagttttcctacagctaagaccagaataccgtgttcacagctataatgcatctgagacttctcagctcctgtctgtttcagaaggtgaactaattttgcacaaagtcagagttaatcaaaataatctccaggctcaagtcattgttgattatttgtgtaagctgagctctttgcctgcagagcagcatcctgtcttgctgggcagtaccagctttgctctgctctgccagctgagtgtgaagaagatacagctctttgatacccaagatctgatcaatgttttgaaagcttttgtcattttaggaatccctcactcccattcaatgctagatgtgtatgagaccaagtgttgccatcaggtatgggagatgaatatggatcagctccttttggtggctgatctctggaggtacttaggccgcaaagtacctaggtttttaaacattttttctagttatcttaatttgcactggaaggatctatccttgtctcagctagttcacttaatttatgttataggtgaaaatcgtcaggtatcccaggacctaatgcaaaaattggaatcattgatccttaaatatatagatttgatcaatttggaggaggttggtaccatctgtttggggttctttaaatcaagtactaatctctctgaatttgtcatgcggaaaattggagacttggcttgtgctaacattcagcatctgagtagtcgctccttagtgaatattgttaaaatgttccgtttcactcacgtggatcacatcaatttcatgaagcagattggagagatagctcctcagcgaattccttccctgggagttcaaggtgtcatgcacctgactctttactgctcggccttacgcttcctgaatgaaggagtaatgaatgcagtggctgcgtctttgcctcctagagtggcacactgtcgaagtaaagatgttgccaagattctgtggtcatttggaactctgaattataagccacccaatgcagaagaattttactccagcctgataagtgagattcacagaaagatgcctgaattcaaccagtacccagaacacctgcccacctgcctgctgggcctggcatttttggagtactttccagtagagttaattgatttcgctctcagtccagggtttgtcaggttagctcaggagagaactaagtttgacctccttaaggaactatataccctcgatggtacagttggcattgagtgtccagattacagaggcaatcgtcttagtactcaccttcagcaagaggggtctgaattgctgtggtatttagcagagaaggatatgaattcaaagcctgaattcttagaaactgtctttttactggagaccatgctgggggggccccagtacgtcaagcaccatatgattttgcctcatacccgatcttctgacttagaggtccagcttgatgttaacctgaagccattaccatttaatagagaagccacgccggctgaaaatgtagccaaattaaggcttgagcatgtgggagtcagccttacagatgatttgatgaataagttactaaaagggaaagcaagaggacatttccagggcaaaactgagtcagagcctgggcagcagcccatggagttggagaataaggcagctgtacctctggggggcttcctttgcaatgtagcagataaatcaggggccatggagatggctggcctgtgccccgcagcctgcatgcagaccccaagaatgaagctggctgttcagttcacaaacaggaaccagtattgctatggctccagggatctccttggactgcacaatatgaagaggcggcagctggctcggcttggctaccgtgtggtagagttatcctactgggaatggctcccactactgaaacgaactcgcttagaaaagttggcgtttcttcatgagaaagtattcacctctgctctctgaagggcatttaggggcatttctatggcaaagctataggtgtatactgtaccaggtgttgcaaaatgattataaaagccagaatgtaagtttggcgataaaatagtgtgttgaggagacttaattgtatccaaggcaggttagagctagtgtatgttactgtgaattgtaatgtagttggattgtacaaattactgcaaatgtatacatgttactcttagtaaataataaacatcttaatatgtcctacggtcaagtaagtccttgttggatttttctttctgtttaccagccttatgtcacagagtttttagaataaaagtatagtcagacattatataaagccaatttttaaaaattttattcttttctggagaccctccccccacccttacagattttttttttttttaaagccagtttttttgtttgttttttgagatggagtctcgctctgtcacccaggctggaatgcagtggcacaatctcagctcactgcancctccgcctcccagattcaaacaattctcctgctcatgcctgttatctcagcctttnggaggccaaagtgggaagattgcttgagtccaggagtttgagaccagcctggccaacatngtgagaccttgcctctgcaaaaaaataaaattagccaggcgtggtggtgtgcccccgcngtcctagctnctcnggaggctgggtgggaggatctgttgagcctgggaggttgaggctgcantgagctgagatgacaccactgtnctttagcctggatgacagagcaagaccctaactcaaaaaaaaaa

SEQ ID NO: 458788 - DNA, 4164 bp, Homo sapiens
tagcgggcagttggccggaagtggggctgtgaggctcggagtcgccggaggagccagtatctgtgtcgccgccgcccgcggcgtccccggtttggtgttgcggcgcccaccttcgggaggatcaggctgcttctgatgcttggaagatatcctctcagccacaaagatggtaataaatctttgcctcccacagttcagaccaagaattcactgcaacaagatatcagctgatggttacgaagtagaaaatctcatctctgaagatctcacaaagagaagtcatggtttcaggacagagtatttcattaagccaccagtctatgtgacagtttcatttccctttaatgtggaaatctgtaggatcaacatagacctcacagctgggggaggtcagaacgtcactggcctggaaatgtacacatctgcctcatctagcagagtgtcttggaatacgccccagtgccggaccctgggcccagctgagccatctgtcccagacaaggaggcgttcaccttggtaggcaaagtcttactgaaaaaccagagccaagtggtgtttagccacaggggcttcaaggccaggcccccttttggcgcgatggaagccacactcccctcccctgctgttgtggcccaggagctctggaataaaggggctctttcccttagccacgtggcccacttaaggatctgtatcacccatgtgacaggcggcggtatcccttgtatcaagcggttggaagtgtggggtcagccggccaagacctgctcccaggaagtgatagacagcatcctgctggtcacctcagagaacctgcctcaggatgtggctctgcaggctccagccttgcccatggaaagtgactgtgaccctggggaccagcctgagagccagcaggctccctccagcctgcagaagctggccgagatcattcaggatgtgcctgaggagttcctggatcccatcaccctggagatcatgccttgtcccatgctgctgccctcaggcaaggtcatcgaccagagcacactggagaagtgtaaccgcagtgaagccacatggggccgagtgcccagtgaccctttcacgggggtagcttttactccgcactctcagcccctgcctcacccctccctcaaggcccggattgaccatttcctgctccagcactccatccctggctgccacctgcttgggagagcacagacggcattggcagtgatcccttcttccattgttctgccctctcagaaaaggaagatagagcaggctgaacatgtcccagacagtaactttggtgtaaatgcttcctgtttttctgccacaagccctttggtcttacccactacctcagagcacactgctaagaaaatgaaagccaccaatgagcccagcctgacacatatggactgctcgacagagcagcctgggagcatcctgggccccgaatgtgcctcctgcaaaagagtattttctccctacttcaaaaaggagccggtgtaccagctgccctgcggccacctcctgtgccgaccctgcctgggtgagaagcaacgctccctgcccatgacgtgcacagcctgccagcggccggttgctagccaagacgtgctgcgggtccacttctgagtgactgacctccactggaggagacccattgctgggaggagctgagggggaacaggagcagggccacagcacccctgaggtctggccaggccccaggcacagagctgcctgctccctcccggggctcttcttcatcacctcacggtatagcacattgcttctgcgctggtggcaatagggcaacaaagccataggccagagggcggggggatgtccctgcctccctgccaccccccctgcctgagcccaggacccactggagccagccccaccctaggcaggaagacccctgctgagggcccccccgtgcagtccgcatacccccctgtccagcagggcactgtgggtggctcaccctagattgtggcccagatctcaggagtctctgccttcagggtcatccaaaagtggaccttgggagcagtgggggtgtctgtggagtgcatgactcagccccccgactcgcagccttaataaagcgatggttgacgtctgctgtgggtttcctcctggtggagtgcctgtctgtgtcacacactcctgtcgcccacctgcacccacacaagtggagctcacagggtagctgtgtgcagtcactgcagcttgccaggctgtcattcctgtcgacgacctgaaaggacacaaactggaattttcaggtctgtcccctgcatggggactcagaacccaggtttgcaggtgggcatacgtggtgggagggtggagggctccctctggccagtgccagctgtgctcagctggcttcagaaactgctccctgagggggagcgcagcgtttcctcatgcagttggtttcaggaaaaatacttgtttataggctgcatccttttttcagcccaacatttagctttatggagtgccaaagggaaaatatatccatatccctacaacttggtactctatcagattccagccactagaagaacctcagtgagaaaacacacccgcctttccctgttcccttctaagcacgtttgggaaggaacagcctaaagatgctttgtaaagctgtattttacccttgagcttagccgcgggtccctgtgaaccggcacattcctttcctttaggccgtccagagctctagtccacacccaatactttagagatctgggtttggggttagttgctttttttttttttttttttaattgagacagggttggtctctgttgcccaagcttgagggcagtggtgcaatcataactcattgcagcctcgaactcctgggcttaagggatccttctacctcagcctcccaggtagcaggaactataggcatgtgccaccatgcccagctaatttttttattttttgtagagacaaggtcttgctatgttgtccagactggtctcaaactcctgggctcaagcgatactcccagagtgcttggattgcaggcatgagccacttcgcctagccaagcctgcatttttttgagttcctacatcatttgtccacaaagatggcttcagagaggtggtcacatgctttgctctgcttcctcttggcactgaccttgatgcagccttcacatgagatttgagggtccgcatggatggcctgtgccgccctcgctggcgaggctcctgtgtgcccctggctttctgggtctgtgcctctccagaatcttgtcttaccctccggtgtgcttgtgttcttagaaaagccccagcatggccgggcatggtggctcatgcctattatcccagcactttgggaggccaaggtgggtggatcacttgaggtcaggagttcgagaccagcctggccaacatggcaagaccccatctctactaaaaatacaaggattagctgggcatggtggtgtgtgcctgtaatgccagctactcaggaggctgaggcatgagaatcgcttgagccggggaggcagaggttgcagtgagccgagatcgcaccactgtactccagcctgggcgacggagtgagactccctctcaaaaaaagaaaaaagccccagcatgtagcaaaagcatttcttggtgagtgtgggggctggtgattcccaccttcaccctgtcatggtctcagggaacagcctgcttcccaccagcagcttgacacccacagtgtgctctggctgctgggagcccatctctcggagaaaccctgtccacccaaccccgagagccctagcgtgcagtcagcgtcagcacggcgctcccagatgagggccggactgcctccccttaagcagctgtgttggaggtactgcccagaccgctgcaggtccctggggatctgcatttctaacaggctcctgcccccaagactgctctggtggaaaatccagcctgggagcccctggagtggcaggccctgtcctgggtacaggtggagccacccccaggagttgcgtgtgtttttcttaattgaaagacttcccccaaaaggaagtggtcttttcactacccttgccagaaacatgctaggcaccactgggctctgtttctgtcccctagaaaatgggaataaaatttcttttgctgtca

SEQ ID NO: 458789 - DNA, 703 bp, Homo sapiens
tgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccac

SEQ ID NO: 458790 - DNA, 757 bp, Homo sapiens
tgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcgggcctctcatcatgcctatgcccacttcacctctgactcctgccttggttacaggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccac

SEQ ID NO: 458791 - DNA, 1073 bp, Homo sapiens
tgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccaccacagcttgggtgtgtgttcatccttgttctttgtgtgttttgttcgggcatgtgtgtgcttgcctgtgcctgcacattcatgagcctgagagagcatctttgatgtgtatttgtgtttggtgtatgtatctggggcagggagtgttcctgctcttgcagggtctacgctgtgaatgcagcttttggtttgtttgcttttgcttgcatatattttagtgcatacatttctgtgggctcctacgtagtggaaaggaatttcttctgcttttttgcgatactgcccatgaaacacggccctccccagcacctgtttttgttgattgtgtcctgttcatagacgggaacgctacttatgagtgccatctaaaa

SEQ ID NO: 458792 - DNA, 501 bp, Homo sapiens
tgacttgtccctggcacaagtgtgctgatatcccttccccctccttcctcacgtcctgcatctcagcgagaattggggtgccggggttagctgtgtggccgtcatcccaggcccaggtgaagccctcgatcaggtgaggccatgatcccaacgagtgttttagcccagatcctgcctcttccctgctttctgccgagaagcgggacctcctctatggaaaatatccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccac

SEQ ID NO: 458793 - DNA, 869 bp, Homo sapiens
  misc_feature (869)..(869): n is a, c, g, or t
cagaacctttccaattgaagggaaatttgacttacagagacagaaattgaggatagagagggtgggtccttccctggagtcacaaatcaagtgagtgggagaggcagaattagaacccagatctctgtcccttttaccacctgcttttcctcaccccccagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccacaaaaaaaaaaacacatagaaaaaaaaaacaatttttcggccgcccttgggcgccacggggaagaggttttcttacaccccattccgttttggggccgggggccccccacgaaagtttggggctcacaccagtggggcacatcactgggtaccccaaacgacagatcctggtgccagttcacataagggggcatcgagtctttcccacgacaataaaaaaacggccggagtggcaaccaagcagttgtttggtagacacaaattccaagataggagttcggaggggccaacacgaggccaatcaacaagggggtccaaagggagactcagtaatcagtgtagcgccgcacggggacatacagtgtccaacaatacagaacacataaccacatgacacaacagaggn

SEQ ID NO: 458794 - DNA, 1343 bp, Homo sapiens
tgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggtaaggcccactcagccatctccacggtccttcctcctctcccgaaatcaggacccacccctcttgtttcctctcatttcctttcctttcctcttcgtttctttctttctttttttttgagagagtcactctgtcacccaggctggagtgcagtagtgtgatcacaacaactcaaacaactcaccgcagcctcgaactcctgggctcaagtgatcctcctgcttcagcctcctgagtggctggaacttcaggtgtacaccacctgcagtggtgagatggggtctcactatgtttcccaggctgatcccaaattcctgggctcaagcaattctcctgccttggcctcccaaagtgctgagattacaggagtgagccaccctgcccagcccactcacccttttctagccaacctgttccttggaccctcacgtcacccctgtctaatcccttatcccaggagtgctatgttactcagcctgggacctcacacacatctggggtcccacattccacagaggggaagcagcaggcttctccctgctcttcccatccccacaaccctgaacccctgcctctcctctgacagggcctctcatcatgcctatgcccacttcacctctgactcctgccttggttacaggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccac

SEQ ID NO: 458795 - DNA, 906 bp, Homo sapiens
tgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccacaaaaaaaaaaaaaaaaaaaaaaaaaaaaaaaaccccggggaaaaaagggagggggagggaaaaaaaggggaaaaaaatgtgcaccgtgtgaaaagagaggattcttggaaacaaagatagtaggaaacaagggtggaaaaatagggagagacaacaaaaaagagagaacggaagaaatgatataaacagggtaacagtgtgtc

SEQ ID NO: 458796 - DNA, 369 bp, Homo sapiens
  misc_feature (11)..(11): n is a, c, g, or t
atcagtcggtnctgctgcacttggagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccac

SEQ ID NO: 458797 - DNA, 632 bp, Homo sapiens
tgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaagatcccccagaaaagaaagctacagaagaaactggggctcctccagggtggcagcaacaataaatagacacgcacggcagccac

SEQ ID NO: 458798 - DNA, 555 bp, Homo sapiens
tgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacacccccccctcctctgtgctgcctcctctgtgctcctcctctgtcctcctctgtgctgtcgggt

SEQ ID NO: 458799 - DNA, 1055 bp, Homo sapiens
tgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcgggcctctcatcatgcctatgcccacttcacctctgactcctgccttggttacaggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaacacagcttgggtgtgtgttcatccttgttctttgtgtgttttgttcgggcatgtgtgtgcttgcctgtgcctgcacattcatgagcctgagagagcatctttgatgtgtatttgtgtttggtgtatgtatctggggcagggagtgttcctgctcttgcagggtctacgctgtgaatgcagcttttggtttgtttgcttttgcttgcatatattttagtgcatacatttctgtgggctcctacgtagtggaaaggaatttcttctgcttttttgcgatactgcccatgaaacacggccctccccagcacctgtttttgttgattgtgtcctgttcatagacgggaacgctacttatgagtgccatctaaaa

SEQ ID NO: 458800 - DNA, 800 bp, Homo sapiens
tgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcacagcttgggtgtgtgttcatccttgttctttgtgtgttttgttcgggcatgtgtgtgcttgcctgtgcctgcacattcatgagcctgagagagcatctttgatgtgtatttgtgtttggtgtatgtatctggggcagggagtgttcctgctcttgcagggtctacgctgtgaatgcagcttttggtttgtttgcttttgcttgcatatattttagtgcatacatttctgtgggctcctacgtagtggaaaggaatttcttctgcttttttgcgatactgcccatgaaacacggccctccccagcacctgtttttgttgattgtgtcctgttcatagacgggaacgctacttatgagtgccatctaaaa

SEQ ID NO: 458801 - DNA, 516 bp, Homo sapiens
  misc_feature (31)..(32): n is a, c, g, or t
  misc_feature (40)..(40): n is a, c, g, or t
ctctagaggatctcggctgcctagcacttcnntctgactntatagctggccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccac

SEQ ID NO: 458802 - DNA, 1108 bp, Homo sapiens
  misc_feature (1108)..(1108): n is a, c, g, or t
tgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccacaaaaaaaaaaacacatagaaaaaaaaaacaatttttcggccgcccttgggcgccacggggaagaggttttcttacaccccattccgttttggggccgggggccccccacgaaagtttggggctcacaccagtggggcacatcactgggtaccccaaacgacagatcctggtgccagttcacataagggggcatcgagtctttcccacgacaataaaaaaacggccggagtggcaaccaagcagttgtttggtagacacaaattccaagataggagttcggaggggccaacacgaggccaatcaacaagggggtccaaagggagactcagtaatcagtgtagcgccgcacggggacatacagtgtccaacaatacagaacacataaccacatgacacaacagaggn

SEQ ID NO: 458803 - DNA, 922 bp, Homo sapiens
tgggctggagccagactgtggtctgaggaggagacacagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccacaaaaaaacacacatccaaaccataaaaaaaatacaaaacaaaaaacagggggggggccagccaaaagatataccgcccagggagggccccacagtacacccggtaacccgcaagttttgctttgacaccaagggggccccccacaaagcgacgcccgcaattaataacacgagaggaccgcggggccggcgtaaacaaacacttggtacgtgggaaaaa

SEQ ID NO: 458804 - DNA, 667 bp, Homo sapiens
atcctaatacgactcactataggactcgagcggccgcccgggcaggtgagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccac

SEQ ID NO: 458805 - DNA, 293 bp, Homo sapiens
cagggtaaaccctgggtataatttgtctagacctccatgtctcctttagtctgagttctgacataattaactgtctatgagatgtactgggcctttcctcattgctttttgatgccacctcactaatgtaaacaaaacattcattttttcatcctattttttcttacagctgcttagcacagtccttatgaaaaaatgaagccttgaaaatggtatatcctctcgacaaagctaagcctgacaagttggctgcattacctagaattagagaagagcaagggcagatggtggga

SEQ ID NO: 458806 - DNA, 2809 bp, Homo sapiens
  misc_feature (1295)..(1295): n is a, c, g, or t
  misc_feature (1297)..(1298): n is a, c, g, or t
  misc_feature (1300)..(1300): n is a, c, g, or t
  misc_feature (2324)..(2324): n is a, c, g, or t
  misc_feature (2357)..(2357): n is a, c, g, or t
  misc_feature (2505)..(2505): n is a, c, g, or t
  misc_feature (2527)..(2527): n is a, c, g, or t
  misc_feature (2529)..(2529): n is a, c, g, or t
  misc_feature (2533)..(2533): n is a, c, g, or t
cagataaagacagagcagcctgtctttatcggaggttcctctgccagtaggaggggcccggagaaaaccagaaagagggccagagccagagaaacatgaagcaccccggggcctcccacaccagtgcctgagcaggaatggggaggggccatgattcacaaggccctgggaggtcactttaaagagggctgctcaactgcaaggacgctgtaagcaggaagagaagccacagcgcttcagaaaagagtgggacagggacaagcatatctaagaggctgaacatgaatccacagatcagaaacccgatgaaggcaatgtatccaggcacattctacttccaatttaaaaacctatgggaagccaacgatcggaacgaaacttggctgtgcttcaccgtggaaggtataaagcgccgctcagttgtctcctggaagacgggcgtcttccgaaaccaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccaggaggggctccgcagcctgagtcaggaaggggtcgctgtggagatcatggactatgaagattttaaatattgttgggaaaactttgtgtacaatgataatgagccattcaagccttggaagggattaaaaaccaactttcgacttctgaaaagaaggctacgggagagtctccagtgaggggtctccctgggcctcatggtctgtctcctctagcctcctgctcatgctgcacgggcctcccctccaccctggacccgctctgtttctgcctggtcatcctgagcccctcctggcctcagggccattccacagtgctcccctgcctcaccgcttcctcctcgctcttccagactcttcctgcagaggctcctttctgcctccatggctatccatccacccccacagaccccgttcctccagcctgcgtgcccctaacctggcttttcccatctccccagcataaccaaatcttactaaactcatcctaggctgggcatggtgactcacgcctgtaatcccccagcaatttgggaggcaaaggtgggagaatcgcgtgagcccaggagttccagaccaggctgggtcacatgacaaagccccatctctacaaaaaaaaanannangaaaagccagatgtggtggcatgcatctgtagtccaagctacttgggaggctgaagtgggaggattacttgagcccgagaggtggaggctggagtgaacagagatcgcgccactgaactcgggtctgggcaacagatagagaccctgcctgaaaataaatcgataaataaactcaacctaaacaggtgtgaatatatgtaagttgaaaacccgaagttttgagaaacatcctttgtaaatttcatcctatgaattgggtcattcatgtcctacccagctaaaacagaggccaggagccagggaggaaaagcagtcaggccacacaacattgtttccgaaatggacttctctgcaagcctgactcctgagactgtgcattgtaccctgaaaccagctttatccatagcttctgcgataaatggctgtaagtcttggactccttgctccaaacgcagcgactcagcaatagaacctcccagctcccagcccttcctagtgcccatgggctttacatagggcaagagaacatttctccttctataattgccatctctttgctctctcaacatggtgaacaccatccggactccgtgtatgtctcaaattacaattctttctttgcaaatgaaatatgaaatttagaggctcttctaaacactttaaatttgatttgacattttcaaagcagatgtaagttttagagaatgagattctccataaaaatgaccctttcatgctgtggcctccatagaagatgtcccaggccaggtgcccacatggcaggcatttattttctcacagatctggaagctgcaggtccaacttcgaggggtgggtggggttgtttcctctgaggccgctccttctggctggcagggagtctcttccagccgtgtcctctgtggcctttcctctatgcacacgcacctctgggatctctctgcctccaaatatcatctttttttttttttttttttttgagacagagtgttgctcctcttgtccaggctggaatgcaatggcncaatctggactcactgcaacctccgcctcccgngtttaagcgattcttctgcttcagcctcccgagtaaaaggcatgcatcaccacacctggttaattttgtagttttagtagagatggggtctcaccatgttggccagactggtctcgaactcctgacctcaggtgatccgcctgtctcngcctctccaagtgctgggattncnggcntcagccactatgcccggctgggatcatatgttccacacatgtttgttcaataagcatggactgcaaccacctacatgaatattcatagctcctcctgtagcctgttgaatatgtatgtttagccaacctcttcagcataaagctcctgcccaaacccctcctgctcctaaatgtctgtctctggtgttaaccagaggctgctcttcccaggctgctggatggctaccttgcaggctgtcacccttaacaagaaataaagtgtcctttgcaaatgca

SEQ ID NO: 458807 - DNA, 1360 bp, Homo sapiens
cagataaagacagagcagcctgtctttatcggaggttcctctgccagtaggaggggcccggagaaaaccagaaagagggccagagccagagaaacatgaagcaccccggggcctcccacaccagtgcctgagcaggaatggggaggggccatgattcacaaggccctgggaggtcactttaaagagggctgctcaactgcaaggacgctgtaagcaggaagagaagccacagcgcttcagaaaagagtgggacagggacaagcatatctaagaggctgaacatgaatccacagatcagaaacccgatgaaggcaatgtatccaggcacattctacttccaatttaaaaacctatgggaagccaacgatcggaacgaaacttggctgtgcttcaccgtggaaggtataaagcgccgctcagttgtctcctggaagacgggcgtcttccgaaaccaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccaggaggggctccgcagcctgagtcaggaaggggtcgctgtggagatcatggactatgaagattttaaatattgttgggaaaactttgtgtacaatgataatgagccattcaagccttggaagggattaaaaaccaactttcgacttctgaaaagaaggctacgggagagtctccagtgaggggtctccctgggcctcatggtctgtctcctctagcctcctgctcatgctgcacgggcctcccctccaccctggacccgctctgtttctgcctggtcatcctgagcccctcctggcctcagggccattccacagtgctcccctgcctcaccgcttcctcctcgctcttccagactcttcctgcagaggctcctttctgcctccatggctatccatccacccccacagaccccgttcctccagcctgcgtgcccctaacctggcttttcccatctccccagcataaccaaatcttactaaactcatcctaggctgggcatggtgactcacgcctgtaatcccccagcaatttgggaggcaaaggtgggagaatcgcgtgagcccaggagttccagaccaggctgggtcacatgacaaagccccatctctacaaaaaaaaacaggacgaggtcgcccagaggccaagcctcccggccgggaccccattccccaggcgtgctgctggc

SEQ ID NO: 458808 - DNA, 2756 bp, Homo sapiens
  misc_feature (1242)..(1242): n is a, c, g, or t
  misc_feature (1244)..(1245): n is a, c, g, or t
  misc_feature (1247)..(1247): n is a, c, g, or t
  misc_feature (2271)..(2271): n is a, c, g, or t
  misc_feature (2304)..(2304): n is a, c, g, or t
  misc_feature (2452)..(2452): n is a, c, g, or t
  misc_feature (2474)..(2474): n is a, c, g, or t
  misc_feature (2476)..(2476): n is a, c, g, or t
  misc_feature (2480)..(2480): n is a, c, g, or t
cagataaagacagagcagcctgtctttatcggaggttcctctgccagtaggaggggcccggagaaaaccagaaagagggccagagccagagaaacatgaagcaccccggggcctcccacaccagtgcctgagcaggaatggggaggggccatgattcacaaggccctgggaggtcactttaaagagggctgctcaactgcaaggacgctgtaagcaggaagagaagccacagcgcttcagaaaagagtgggacagggacaagcatatctaagaggctgaacatgaatccacagatcagaaacccgatgaaggcaatgtatccaggcacattctacttccaatttaaaaacctatgggaagccaacgatcggaacgaaacttggctgtgcttcaccgtggaaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccaggaggggctccgcagcctgagtcaggaaggggtcgctgtggagatcatggactatgaagattttaaatattgttgggaaaactttgtgtacaatgataatgagccattcaagccttggaagggattaaaaaccaactttcgacttctgaaaagaaggctacgggagagtctccagtgaggggtctccctgggcctcatggtctgtctcctctagcctcctgctcatgctgcacgggcctcccctccaccctggacccgctctgtttctgcctggtcatcctgagcccctcctggcctcagggccattccacagtgctcccctgcctcaccgcttcctcctcgctcttccagactcttcctgcagaggctcctttctgcctccatggctatccatccacccccacagaccccgttcctccagcctgcgtgcccctaacctggcttttcccatctccccagcataaccaaatcttactaaactcatcctaggctgggcatggtgactcacgcctgtaatcccccagcaatttgggaggcaaaggtgggagaatcgcgtgagcccaggagttccagaccaggctgggtcacatgacaaagccccatctctacaaaaaaaaanannangaaaagccagatgtggtggcatgcatctgtagtccaagctacttgggaggctgaagtgggaggattacttgagcccgagaggtggaggctggagtgaacagagatcgcgccactgaactcgggtctgggcaacagatagagaccctgcctgaaaataaatcgataaataaactcaacctaaacaggtgtgaatatatgtaagttgaaaacccgaagttttgagaaacatcctttgtaaatttcatcctatgaattgggtcattcatgtcctacccagctaaaacagaggccaggagccagggaggaaaagcagtcaggccacacaacattgtttccgaaatggacttctctgcaagcctgactcctgagactgtgcattgtaccctgaaaccagctttatccatagcttctgcgataaatggctgtaagtcttggactccttgctccaaacgcagcgactcagcaatagaacctcccagctcccagcccttcctagtgcccatgggctttacatagggcaagagaacatttctccttctataattgccatctctttgctctctcaacatggtgaacaccatccggactccgtgtatgtctcaaattacaattctttctttgcaaatgaaatatgaaatttagaggctcttctaaacactttaaatttgatttgacattttcaaagcagatgtaagttttagagaatgagattctccataaaaatgaccctttcatgctgtggcctccatagaagatgtcccaggccaggtgcccacatggcaggcatttattttctcacagatctggaagctgcaggtccaacttcgaggggtgggtggggttgtttcctctgaggccgctccttctggctggcagggagtctcttccagccgtgtcctctgtggcctttcctctatgcacacgcacctctgggatctctctgcctccaaatatcatctttttttttttttttttttttgagacagagtgttgctcctcttgtccaggctggaatgcaatggcncaatctggactcactgcaacctccgcctcccgngtttaagcgattcttctgcttcagcctcccgagtaaaaggcatgcatcaccacacctggttaattttgtagttttagtagagatggggtctcaccatgttggccagactggtctcgaactcctgacctcaggtgatccgcctgtctcngcctctccaagtgctgggattncnggcntcagccactatgcccggctgggatcatatgttccacacatgtttgttcaataagcatggactgcaaccacctacatgaatattcatagctcctcctgtagcctgttgaatatgtatgtttagccaacctcttcagcataaagctcctgcccaaacccctcctgctcctaaatgtctgtctctggtgttaaccagaggctgctcttcccaggctgctggatggctaccttgcaggctgtcacccttaacaagaaataaagtgtcctttgcaaatgca

SEQ ID NO: 458809 - DNA, 2412 bp, Homo sapiens
  misc_feature (898)..(898): n is a, c, g, or t
  misc_feature (900)..(901): n is a, c, g, or t
  misc_feature (903)..(903): n is a, c, g, or t
  misc_feature (1927)..(1927): n is a, c, g, or t
  misc_feature (1960)..(1960): n is a, c, g, or t
  misc_feature (2108)..(2108): n is a, c, g, or t
  misc_feature (2130)..(2130): n is a, c, g, or t
  misc_feature (2132)..(2132): n is a, c, g, or t
  misc_feature (2136)..(2136): n is a, c, g, or t
ttatatcttctttccaagccaagaaagcttcttcttcaataatttccatgtcatagaagtgcacaaaaaagcgaagtaacatgccttttgggaagttgctgttatagcagtgcacctggagagcatacagggcactgacttgtagatcaacgtgatcatgaagaaatttctgcattactggcttgaaagatagtagtagttgtttttcctgctctaactgttctttggaaggagcagaggatgaatctgtttcatcgctgggggggtttacttcactagaaatgtactgtaagaagctagtcaggaaggggtcgctgtggagatcatggactatgaagattttaaatattgttgggaaaactttgtgtacaatgataatgagccattcaagccttggaagggattaaaaaccaactttcgacttctgaaaagaaggctacgggagagtctccagtgaggggtctccctgggcctcatggtctgtctcctctagcctcctgctcatgctgcacgggcctcccctccaccctggacccgctctgtttctgcctggtcatcctgagcccctcctggcctcagggccattccacagtgctcccctgcctcaccgcttcctcctcgctcttccagactcttcctgcagaggctcctttctgcctccatggctatccatccacccccacagaccccgttcctccagcctgcgtgcccctaacctggcttttcccatctccccagcataaccaaatcttactaaactcatcctaggctgggcatggtgactcacgcctgtaatcccccagcaatttgggaggcaaaggtgggagaatcgcgtgagcccaggagttccagaccaggctgggtcacatgacaaagccccatctctacaaaaaaaaanannangaaaagccagatgtggtggcatgcatctgtagtccaagctacttgggaggctgaagtgggaggattacttgagcccgagaggtggaggctggagtgaacagagatcgcgccactgaactcgggtctgggcaacagatagagaccctgcctgaaaataaatcgataaataaactcaacctaaacaggtgtgaatatatgtaagttgaaaacccgaagttttgagaaacatcctttgtaaatttcatcctatgaattgggtcattcatgtcctacccagctaaaacagaggccaggagccagggaggaaaagcagtcaggccacacaacattgtttccgaaatggacttctctgcaagcctgactcctgagactgtgcattgtaccctgaaaccagctttatccatagcttctgcgataaatggctgtaagtcttggactccttgctccaaacgcagcgactcagcaatagaacctcccagctcccagcccttcctagtgcccatgggctttacatagggcaagagaacatttctccttctataattgccatctctttgctctctcaacatggtgaacaccatccggactccgtgtatgtctcaaattacaattctttctttgcaaatgaaatatgaaatttagaggctcttctaaacactttaaatttgatttgacattttcaaagcagatgtaagttttagagaatgagattctccataaaaatgaccctttcatgctgtggcctccatagaagatgtcccaggccaggtgcccacatggcaggcatttattttctcacagatctggaagctgcaggtccaacttcgaggggtgggtggggttgtttcctctgaggccgctccttctggctggcagggagtctcttccagccgtgtcctctgtggcctttcctctatgcacacgcacctctgggatctctctgcctccaaatatcatctttttttttttttttttttttgagacagagtgttgctcctcttgtccaggctggaatgcaatggcncaatctggactcactgcaacctccgcctcccgngtttaagcgattcttctgcttcagcctcccgagtaaaaggcatgcatcaccacacctggttaattttgtagttttagtagagatggggtctcaccatgttggccagactggtctcgaactcctgacctcaggtgatccgcctgtctcngcctctccaagtgctgggattncnggcntcagccactatgcccggctgggatcatatgttccacacatgtttgttcaataagcatggactgcaaccacctacatgaatattcatagctcctcctgtagcctgttgaatatgtatgtttagccaacctcttcagcataaagctcctgcccaaacccctcctgctcctaaatgtctgtctctggtgttaaccagaggctgctcttcccaggctgctggatggctaccttgcaggctgtcacccttaacaagaaataaagtgtcctttgcaaatgca

SEQ ID NO: 458810 - DNA, 1123 bp, Homo sapiens
cagataaagacagagcagcctgtctttatcggaggttcctctgccagtaggaggggcccggagaaaaccagaaagagggccagagccagagaaacatgaagcaccccggggcctcccacaccagtgcctgagcaggaatggggaggggccatgattcacaaggccctgggaggtcactttaaagagggctgctcaactgcaaggacgctgtaagcaggaagagaagccacagcgcttcagaaaagagtgggacagggacaagcatatctaagaggctgaacatgaatccacagatcagaaacccgatgaaggcaatgtatccaggcacattctacttccaatttaaaaacctatgggaagccaacgatcggaacgaaacttggctgtgcttcaccgtggaaggtataaagcgccgctcagttgtctcctggaagacgggcgtcttccgaaaccaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccaggaggggctccgcagcctgagtcaggaaggggtcgctgtggagatcatggactatgaagattttaaatattgttgggaaaactttgtgtacaatgataatgagccattcaagccttggaagggattaaaaaccaactttcgacttctgaaaagaaggctacgggagagtctccagtgaggggtctccctgggcctcatggtctgtctcctctagcctcctgctcatgctgcacgggcctcccctccaccctggacccgctctgtttctgcaggaggggccccgcaggccgccaagctggacagtgtagcgcctgggcagtcttccagtgggagatccgaagagaaggggtccggagttacctggaaggaggagctgacagaggcaaaagggggtgaagctaagggagagggatgggaggggtgtcaaagtgcgggagagtagacagg

SEQ ID NO: 458811 - DNA, 937 bp, Homo sapiens
cagataaagacagagcagcctgtctttatcggaggttcctctgccagtaggaggggcccggagaaaaccagaaagagggccagagccagagaaacatgaagcaccccggggcctcccacaccagtgcctgagcaggaatggggaggggccatgattcacaaggccctgggaggtcactttaaagagggctgctcaactgcaaggacgctgtaagcaggaagagaagccacagcgcttcagaaaagagtgggacagggacaagcatatctaagaggctgaacatgaatccacagatcagaaacccgatgaaggcaatgtatccaggcacattctacttccaatttaaaaacctatgggaagccaacgatcggaacgaaacttggctgtgcttcaccgtggaaggtataaagcgccgctcagttgtctcctggaagacgggcgtcttccgaaaccaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccaggaggggctccgcagcctgagtcaggaaggggtcgctgtggagatcatggactatgaagattttaaatattgttgggaaaactttgtgtacaatgataatgagccattcaagccttggaagggattaaaaaccaactttcgactcctgctcctaaatgtctgtctctggtgttaaccagaggctgctcttcccaggctgctggatggctaccttgcaggctgtcacccttaacaagaaataaagtgtcctttgcaaatgca

SEQ ID NO: 458812 - DNA, 998 bp, Homo sapiens
cagataaagacagagcagcctgtctttatcggaggttcctctgccagtaggaggggcccggagaaaaccagaaagagggccagagccagagaaacatgaagcaccccggggcctcccacaccagtgcctgagcaggaatggggaggggccatgattcacaaggccctgggaggtcactttaaagagggctgctcaactgcaaggacgctgtaagcaggaagagaagccacagcgcttcagaaaagagtgggacagggacaagcatatctaagaggctgaacatgaatccacagatcagaaacccgatgaaggcaatgtatccaggcacattctacttccaatttaaaaacctatgggaagccaacgatcggaacgaaacttggctgtgcttcaccgtggaaggtataaagcgccgctcagttgtctcctggaagacgggcgtcttccgaaaccaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccaggaggggctccgcagcctgagtcaggaaggggtcgctgtggagatcatggactatgaagccggctgggatcatatgttccacacatgtttgttcaataagcatggactgcaaccacctacatgaatattcatagctcctcctgtagcctgttgaatatgtatgtttagccaacctcttcagcataaagctcctgcccaaacccctcctgctcctaaatgtctgtctctggtgttaaccagaggctgctcttcccaggctgctggatggctaccttgcaggctgtcacccttaacaagaaataaagtgtcctttgcaaatgca

SEQ ID NO: 458813 - DNA, 2755 bp, Homo sapiens
  misc_feature (1241)..(1241): n is a, c, g, or t
  misc_feature (1243)..(1244): n is a, c, g, or t
  misc_feature (1246)..(1246): n is a, c, g, or t
  misc_feature (2270)..(2270): n is a, c, g, or t
  misc_feature (2303)..(2303): n is a, c, g, or t
  misc_feature (2451)..(2451): n is a, c, g, or t
  misc_feature (2473)..(2473): n is a, c, g, or t
  misc_feature (2475)..(2475): n is a, c, g, or t
  misc_feature (2479)..(2479): n is a, c, g, or t
cagataaagacagagcagcctgtctttatcggaggttcctctgccagtaggaggggcccggagaaaaccagaaagagggccagagccagagaaacatgaagcaccccggggcctcccacaccagtgcctgagcaggaatggggaggggccatgattcacaaggccctgggaggtcactttaaagagggctgctcaactgcaaggacgctgtaagcaggaagagaagccacagcgcttcagaaaagagtgggacagggacaagcatatctaagaggctgaacatgaatccacagatcagaaacccgatgaaggcaatgtatccaggcacattctacttccaatttaaaagtataaagcgccgctcagttgtctcctggaagacgggcgtcttccgaaaccaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccaggaggggctccgcagcctgagtcaggaaggggtcgctgtggagatcatggactatgaagattttaaatattgttgggaaaactttgtgtacaatgataatgagccattcaagccttggaagggattaaaaaccaactttcgacttctgaaaagaaggctacgggagagtctccagtgaggggtctccctgggcctcatggtctgtctcctctagcctcctgctcatgctgcacgggcctcccctccaccctggacccgctctgtttctgcctggtcatcctgagcccctcctggcctcagggccattccacagtgctcccctgcctcaccgcttcctcctcgctcttccagactcttcctgcagaggctcctttctgcctccatggctatccatccacccccacagaccccgttcctccagcctgcgtgcccctaacctggcttttcccatctccccagcataaccaaatcttactaaactcatcctaggctgggcatggtgactcacgcctgtaatcccccagcaatttgggaggcaaaggtgggagaatcgcgtgagcccaggagttccagaccaggctgggtcacatgacaaagccccatctctacaaaaaaaaanannangaaaagccagatgtggtggcatgcatctgtagtccaagctacttgggaggctgaagtgggaggattacttgagcccgagaggtggaggctggagtgaacagagatcgcgccactgaactcgggtctgggcaacagatagagaccctgcctgaaaataaatcgataaataaactcaacctaaacaggtgtgaatatatgtaagttgaaaacccgaagttttgagaaacatcctttgtaaatttcatcctatgaattgggtcattcatgtcctacccagctaaaacagaggccaggagccagggaggaaaagcagtcaggccacacaacattgtttccgaaatggacttctctgcaagcctgactcctgagactgtgcattgtaccctgaaaccagctttatccatagcttctgcgataaatggctgtaagtcttggactccttgctccaaacgcagcgactcagcaatagaacctcccagctcccagcccttcctagtgcccatgggctttacatagggcaagagaacatttctccttctataattgccatctctttgctctctcaacatggtgaacaccatccggactccgtgtatgtctcaaattacaattctttctttgcaaatgaaatatgaaatttagaggctcttctaaacactttaaatttgatttgacattttcaaagcagatgtaagttttagagaatgagattctccataaaaatgaccctttcatgctgtggcctccatagaagatgtcccaggccaggtgcccacatggcaggcatttattttctcacagatctggaagctgcaggtccaacttcgaggggtgggtggggttgtttcctctgaggccgctccttctggctggcagggagtctcttccagccgtgtcctctgtggcctttcctctatgcacacgcacctctgggatctctctgcctccaaatatcatctttttttttttttttttttttgagacagagtgttgctcctcttgtccaggctggaatgcaatggcncaatctggactcactgcaacctccgcctcccgngtttaagcgattcttctgcttcagcctcccgagtaaaaggcatgcatcaccacacctggttaattttgtagttttagtagagatggggtctcaccatgttggccagactggtctcgaactcctgacctcaggtgatccgcctgtctcngcctctccaagtgctgggattncnggcntcagccactatgcccggctgggatcatatgttccacacatgtttgttcaataagcatggactgcaaccacctacatgaatattcatagctcctcctgtagcctgttgaatatgtatgtttagccaacctcttcagcataaagctcctgcccaaacccctcctgctcctaaatgtctgtctctggtgttaaccagaggctgctcttcccaggctgctggatggctaccttgcaggctgtcacccttaacaagaaataaagtgtcctttgcaaatgca

SEQ ID NO: 458814 - DNA, 2181 bp, Homo sapiens
  misc_feature (667)..(667): n is a, c, g, or t
  misc_feature (669)..(670): n is a, c, g, or t
  misc_feature (672)..(672): n is a, c, g, or t
  misc_feature (1696)..(1696): n is a, c, g, or t
  misc_feature (1729)..(1729): n is a, c, g, or t
  misc_feature (1877)..(1877): n is a, c, g, or t
  misc_feature (1899)..(1899): n is a, c, g, or t
  misc_feature (1901)..(1901): n is a, c, g, or t
  misc_feature (1905)..(1905): n is a, c, g, or t
aggagacgaggaagatggacgaggagaggacgcaatgatgagggggagggagagcgagagctagaaagagggagagagtaggacggaagaggatgaggagtaagaagggatggagaaggtggaggaagaaggagagaggagaatgaggaggagaacaagcaaggcggggagagatatagagaaggggcgaggagtacgggaaaggaggggcggagaagatccaaaggaagggtgtcagtgggccacaaagtggaatcctaaaggcaagggagaataaggcgcagagccgtcgcggctcacgggacaggatctggatgtgccaggtcatcgtgggcccctgatggcctaaggaccatggcacagtgctagggtgcctcagagcgcggatcgctcgtgcgaactcttcctgcagaggctcctttctgcctccatggctatccatccacccccacagaccccgttcctccagcctgcgtgcccctaacctggcttttcccatctccccagcataaccaaatcttactaaactcatcctaggctgggcatggtgactcacgcctgtaatcccccagcaatttgggaggcaaaggtgggagaatcgcgtgagcccaggagttccagaccaggctgggtcacatgacaaagccccatctctacaaaaaaaaanannangaaaagccagatgtggtggcatgcatctgtagtccaagctacttgggaggctgaagtgggaggattacttgagcccgagaggtggaggctggagtgaacagagatcgcgccactgaactcgggtctgggcaacagatagagaccctgcctgaaaataaatcgataaataaactcaacctaaacaggtgtgaatatatgtaagttgaaaacccgaagttttgagaaacatcctttgtaaatttcatcctatgaattgggtcattcatgtcctacccagctaaaacagaggccaggagccagggaggaaaagcagtcaggccacacaacattgtttccgaaatggacttctctgcaagcctgactcctgagactgtgcattgtaccctgaaaccagctttatccatagcttctgcgataaatggctgtaagtcttggactccttgctccaaacgcagcgactcagcaatagaacctcccagctcccagcccttcctagtgcccatgggctttacatagggcaagagaacatttctccttctataattgccatctctttgctctctcaacatggtgaacaccatccggactccgtgtatgtctcaaattacaattctttctttgcaaatgaaatatgaaatttagaggctcttctaaacactttaaatttgatttgacattttcaaagcagatgtaagttttagagaatgagattctccataaaaatgaccctttcatgctgtggcctccatagaagatgtcccaggccaggtgcccacatggcaggcatttattttctcacagatctggaagctgcaggtccaacttcgaggggtgggtggggttgtttcctctgaggccgctccttctggctggcagggagtctcttccagccgtgtcctctgtggcctttcctctatgcacacgcacctctgggatctctctgcctccaaatatcatctttttttttttttttttttttgagacagagtgttgctcctcttgtccaggctggaatgcaatggcncaatctggactcactgcaacctccgcctcccgngtttaagcgattcttctgcttcagcctcccgagtaaaaggcatgcatcaccacacctggttaattttgtagttttagtagagatggggtctcaccatgttggccagactggtctcgaactcctgacctcaggtgatccgcctgtctcngcctctccaagtgctgggattncnggcntcagccactatgcccggctgggatcatatgttccacacatgtttgttcaataagcatggactgcaaccacctacatgaatattcatagctcctcctgtagcctgttgaatatgtatgtttagccaacctcttcagcataaagctcctgcccaaacccctcctgctcctaaatgtctgtctctggtgttaaccagaggctgctcttcccaggctgctggatggctaccttgcaggctgtcacccttaacaagaaataaagtgtcctttgcaaatgca

SEQ ID NO: 458815 - DNA, 844 bp, Homo sapiens
cagataaagacagagcagcctgtctttatcggaggttcctctgccagtaggaggggcccggagaaaaccagaaagagggccagagccagagaaacatgaagcaccccggggcctcccacaccagtgcctgagcaggaatggggaggggccatgattcacaaggccctgggaggtcactttaaagagggctgctcaactgcaaggacgctgtaagcaggaagagaagccacagcgcttcagaaaagagtgggacagggacaagcatatctaagaggctgaacatgaatccacagatcagaaacccgatgaaggcaatgtatccaggcacattctacttccaatttaaaaacctatgggaagccaacgatcggaacgaaacttggctgtgcttcaccgtggaaggtataaagcgccgctcagttgtctcctggaagacgggcgtcttccgaaaccaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccaggaggggctccgcagcctgagtcaggaaggggtcgctgtggagatcatggactatgaagattttaaatattgttgggaaaactttgtgtacaatgataatgagctgctggatggctaccttgcaggctgtcacccttaacaagaaataaagtgtcctttgcaaatgca

SEQ ID NO: 458816 - DNA, 2512 bp, Homo sapiens
cgcaatgctgccgtgcgccgcgggagccagggggcgtggggccatggtggtcttgcgggcggggaagaagacctttctccccgctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctc

SEQ ID NO: 458817 - DNA, 2250 bp, Homo sapiens
cgcaatgctgccgtgcgccgcgggagccagggggcgtggggccatggtggtcttgcgggcggggaagaagacctttctccccgctctctgccgcgccttcgcctgccgcggctgtcaactcgctccggagcgcggcgccgagcgcagggatacggcgcccagcggggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctc

SEQ ID NO: 458818 - DNA, 1713 bp, Homo sapiens
gcactgggtgcccgtttcctgtgtttgggctttatttcacaccacgtacgtgacaacaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctc

SEQ ID NO: 458819 - DNA, 2609 bp, Homo sapiens
actctgtctcaaaaaaaaaaaagaaagcttagcaaaggtggttgagtttcgggaaagggctgttattatttaaaccagaaactaggccctgtgtggtggctcctacttgtaatcccagcactttggctgagatcacgccactacactccagtctggcaacagagcgagctccgtctctaagtaaataaataaatccagattgtacattttataatactagagattcattttgtcatatgttaatccaatttactttgttaaaggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctc

SEQ ID NO: 458820 - DNA, 2633 bp, Homo sapiens
cgcaatgctgccgtgcgccgcgggagccagggggcgtggggccatggtggtcttgcgggcggggaagaagacctttctccccgctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcagatggagtctcactctgtcacccaggctggagtgcagtggcacgatctcggctcactgcaaactctgcctcctggttcaagcgattctcctgcctcagccttctgagtagctgggactacaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctc

SEQ ID NO: 458821 - DNA, 2293 bp, Homo sapiens
ggaagacaaacccgggcctcggggccactccctgttctgcacagccgcctcaggcctttgtccaggtgctctcgcgtcctatcccgaacagtcccgcagccccgaggctcccgcatcaacgccctcagtcggatgggactgagggtgccgccgccaccacgccggggactgttgacagccagaacctttaagcgtaacagagtcacctggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctc

SEQ ID NO: 458822 - DNA, 2992 bp, Homo sapiens
ctcggttttcagtaagtgtggtgaactcggtgttttgcctctttccctgaacttagcggtaggttcggtattaagctgcagtgctgcagtgtggatggtgccctgcttagcagatattacagtgcttctgctgcttgttgagccttggcctgggggtgtttgagccaaatgcaaggagacctgtcctgagggacgcccatgtcaatggagtcaggtggcagcagctggtacccctgcctttgggatactcccgtggtcaccctaacagcagtgaccacaagcaagcacttctgtgccagccgcgcccctcctgccacactgacggagtgtagcttcatgaggtgcgcggttgctgtcacacactagagaggaagaaactgagatggaggtaagtcacagctctggggccacacagccaggtggggacagtcttggcctctgtccatcccagatgaggtctcgctatgttgaccaggctggcctcaagcagtcttcctgcctcaacctctgagtacggacacagttttgagcgccctatatgtgtattaacagtaacacatgagacagagtaggccctctttatccgagggatacattccaagacccccagtgaatgcctaagactgaggctagtaccaagccctgtatgtacactaggtttttccctacacggttgtccctcccctatgtcctcagttcaaccaaccacagattgaaaaatattgaaaacaataaacatataaacaataaaatattgaaaataaaaaatacaattttttctttttagatggagtctcactctgtcacccaggctggagtgcagtggcacgatctcggctcactgcaaactctgcctcctggttcaagcgattctcctgcctcagccttctgagtagctgggactacaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctc

SEQ ID NO: 458823 - DNA, 2663 bp, Homo sapiens
cgcaatgctgccgtgcgccgcgggagccagggggcgtggggccatggtggtcttgcgggcggggaagaagacctttctccccgctctctgccgcgccttcgcctgccgcggctgtcaactcgctccggagcgcggcgccgagcgcagggatacggcgcccagcgggccgcctcaggcctttgtccaggtgctctcgcgtcctatcccgaacagtcccgcagccccgaggctcccgcatcaacgccctcagtcggatgggactgagggtgccgccgccaccacgccggggactgttgacagccagaacctttaagcgtaacagagtcacctggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggtcagaaagcaacattgaatgcagaagaaatggcggacttctacaaggaatttttaagtaaaaattttcagaagcacatgtattataacaggttggatacggtggctcgcacctggaatcccatgactttgggaggccaagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctc

SEQ ID NO: 458824 - DNA, 694 bp, Homo sapiens
tccaagttctcttgcacacccagttcccaggcatggctctccaatctcagctccctcctttctctccggattttaggtggttatgatggatgaccaacctctgacctttgactttcgtactgaggtctcagcctttgcagcttctccctccaaagcagcttttcttctgattcctgatctcagttcagtgctcaaaatagcctctccttattttctcctggtgtcagtgttaggcctgaataacatctcatgctgttcgttaaacagatgtctgctgccaaaaagttgttctgatagaaaatccaaaatcatcgaccccaaaagccaagtctgtcattgggctaaagtgccattcctactaatcctttgcctcacctgattcatttggaataaagggccaggagcttgagtcacccccaaaccaggacctctgttgctatttgctggctgctggagaggtggggtcttgcgggccctggagaggtggggtcttgtggggcagagctggagcagatgctgcatccagcagtaagcatgagaatgagcactcacagttttgggtcctgtgctggacactgtgcaagtcctgtgcatatatcacctgttgcatttcccacagtgacccaatgaagtagatactgttatctttaccattttatagatgagcaacctgaggcttcaccagaattgcaca

SEQ ID NO: 458825 - DNA, 285 bp, Homo sapiens
ctgaactcatttattagctctaatagttttttgtttatcctttctccttaagtcttaatgtttaagctgaaattacctttcaggtcagaaagcaacattgaatgcagaagaaatggcggacttctacaaggaatttttaagtaaaaattttcagaagcacatgtattataacaggtaggtgtttactcttttcctgaaaatttgaatagcacatccagattaggtaggagtgttttcttacctgaatttaacaacattcatgtttatatcagaggtagaagttgc

SEQ ID NO: 458826 - DNA, 2448 bp, Homo sapiens
cgcaatgctgccgtgcgccgcgggagccagggggcgtggggccatggtggtcttgcgggcggggaagaagacctttctccccgctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctc

SEQ ID NO: 458827 - DNA, 2677 bp, Homo sapiens
cgcaatgctgccgtgcgccgcgggagccagggggcgtggggccatggtggtcttgcgggcggggaagaagacctttctccccgctctctgccgcgccttcgcctgccgcggctgtcaactcgctccggagcgcggcgccgagcgcagggatacggcgcccagcgggccgcctcaggcctttgtccaggtgctctcgcgtcctatcccgaacagtcccgcagccccgaggctcccgcatcaacgccctcagtcggatgggactgagggtgccgccgccaccacgccggggactgttgacagccagaacctttaagcgtaacagagtcacctggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctc

SEQ ID NO: 458828 - DNA, 2491 bp, Homo sapiens
ggaagacaaacccgggcctcggggccactccctgttctgcacagccgcctcaggcctttgtccaggtgctctcgcgtcctatcccgaacagtcccgcagccccgaggctcccgcatcaacgccctcagtcggatgggactgagggtgccgccgccaccacgccggggactgttgacagccagaacctttaagcgtaacagagtcacctggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctc

SEQ ID NO: 458829 - DNA, 2683 bp, Homo sapiens
cgcaatgctgccgtgcgccgcgggagccagggggcgtggggccatggtggtcttgcgggcggggaagaagacctttctccccgctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcagatggagtctcactctgtcacccaggctggagtgcagtggcacgatctcggctcactgcaaactctgcctcctggttcaagcgattctcctgcctcagccttctgagtagctgggactacaggtcagaaagcaacattgaatgcagaagaaatggcggacttctacaaggaatttttaagtaaaaattttcagaagcacatgtattataacaggttggatacggtggctcgcacctggaatcccatgactttgggaggccaagagattggtacaagcgcaattttgccatcaccttcttcatgggaaaagtggccctggaaaggatttggaacaagcttaaacagaaacaaaagaagaggagcaactaggagtccactctgacccagccagagtccaggtttccacaggaagcagatggagctcctttcacaggggctctgagaaaaactggagctgatctcaagaagccccacatcttcctaaggggccccatggcctgtttgggggcagggtaggtcctggggcactgtgggccgcctgcctgctgatgtgggctctaggccagcttgttgtcacgtacgtggtgtgaaataaagcccaagcactgggtgcccgtttcctgtgtttcgaattataccaattcaaaacagaactatttaaaaatattggccaggcacggtggctcacacctgtaatcccagcactttgggaggccgaggcgggtggatcacttgagatcaggagttcaagatcagtctggacaacatggcaaaaccctgtctctacaaaaaattagctgggtgtggtggcacgcacctgtaatcccagctgctctggaggctgaggcatgcgacgcttgaacccaggaggcggaggttgcagtgatccaagatcgcaccactgcactccagcctggaagaccaaacgagactctgtatcaaaaaataataataattaataaagttttactggaaaaaagaagtctgctgacgggaatgatgtggaagctgactgccaagcgatcggtgtgctggccgtggagtcagcaccaccctcactgtgagtcgtcagctggtgggtcctcacaggctgcgtcctgaatgcagtgcggtgtgaggacatgaaagcaaatgcaattttattgcatgccaaaaagtttaacttgattcttggtgttaactatgttagtagattcttcaatgctataagcaaattaacaagaaacagcagcactattttcctcttttcttaaacacgaaggttaaatggccaggcatggtgactcatacctgtaatcccaacaatttgggaggccaaggcaagcaaatcacttgagctcaggagttcgaaccagtttgggcaacatggcgaaaccctgcctctacaaaacatgcaaaaattagctgggcatggtagcatgcgcctgtagtcccagctactcgggaggctgagcttcgaggattgattgagccagtgaggtccaggctgcactaagccaagatcctaccactaggcaacagagccagaccctgtctcaaataaaaatttaaaaaaataataaaaaaggccgggcgcactggctcacgcctgtaatctcagcactttgggtggccaaggtgggcggatcacctgaggtcagttcaagaccagcctggccaaacatggtgaaaccctgtctacaaaaattagccaggcatgatggagggtgcctttagtcccagctctttgggaagctgaggcgggagaatagcatgaaccagggaggtggagggtgcctgtaatcccagctccttgggaggctaaggcaggagaatagcatgaacccggtaggtggaggttgcagtgagccgagatcgcgccactgcactccagcctgggcgacagagcaatactcccgtctcaaaaaaaaaaaaaaattaaatgattgtgatatgtgttacttttggtcacaaataaattgtaattaagattattctggccaggtgcggtggctcacgcctataatcccagcactttgggaggccgaggtgggcagatcatgaggtcaggagatcgagaccatcctgcccaacatggtgaaaccccgtttctactaaaaatgcaaaaattagctgggtgtggtggcgtgtgcctgtaatgccagctactcgggaggctgaggcacgagaatcacttgaacccagcaggcagaggttgcagtgagccaagattgcgccactgcactccagcctgacgacaaagcgagactccgtctc

SEQ ID NO: 458830 - DNA, 774 bp, Homo sapiens
cgcaatgctgccgtgcgccgcgggagccagggggcgtggggccatggtggtcttgcgggcggggaagaagacctttctccccgctctctgccgcgccttcgcctgccgcggctgtcaactcgctccggagcgcggcgccgagcgcagggatacggcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactcaagactaaaaactaaaggcctgggcctgagaactgaatcaggtggttatgatggatgaccaacctctgacctttgactttcgtactgaggtctcagcctttgcagcttctccctccaaagcagcttttcttctgattcctgatctcagttcagtgctcaaaatagcctctccttattttctcctggtgtcagtgttaggcctgaataacatctcatgctgttcgttaaacagatgtctgctgccaaaaagttgttctgatagaaaatccaaaatcatcgaccccaaaagccaagtctgtcattgggctaaagtgccattcctactaatcctttgcctcacctgattcatttggaataaagggccaggagcttgagtcacccccaaac

SEQ ID NO: 458831 - DNA, 1223 bp, Homo sapiens
ccagaacacgaaggggggaaaaaacgcttctaatgatccctcagaacttgcatattttcatacgcttttctggggggaggcactaattggggcgcttttcctttgcgaacttacttatcttaaagtcggagcggaaaataaagcacgcacgcaacccaatttccggagaaccgagattgcgacgaacaaccaggaagcggctgggttgagagctgtccccggttctccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctgatgaaaagaaacagatggttgcaaatgtggagaaacagcttgaagaagcgaaagaactgcttgaacagatggatttggaagtccgagagataccaccccaaagtcgagggatgtacagcaacagaatgagaagctacaaacaagaaatgggaaaactcgaaacagattttaaaaggtcacggatcgcctacagtgacgaagtacggaatgagctcctgggggatgatgggaattcctcagagaaccagagggcacatctgctcgataacacagagaggctggaaaggtcatctcggagactagaggctggataccaaatagcagtggaaaccgagcaaattggtcaggagatgttggaaaaccttagtcatgacagagaaaagatacagcgagcacgtgaaagacttcgggaaacagatgctaatttgggaaaaagctccaggattctgacagggatgttgcgaagaatcatccagaaccgcatcctgctcgtcatcctagggatcatcgtggtcatcaccatcctgatggcgatcactttttctgtcagaagacactgatgtatctgctctcccttgataaacagcaacaacagcttgttctgagtaattaagacaaaatggtcacatgaatcattctgttgcgctgacaggccccaggtgaccctctctctccctcaccgccgttgggctgaagtgcaaagagtgtaaaaatattttctattcctgtttgcatgtgggttggtttccttttcgaggtttgtcttcacccagattcgttttttaga

SEQ ID NO: 458832 - DNA, 1133 bp, Homo sapiens
ccagaacacgaaggggggaaaaaacgcttctaatgatccctcagaacttgcatattttcatacgcttttctggggggaggcactaattggggcgcttttcctttgcgaacttacttatcttaaagtcggagcggaaaataaagcacgcacgcaacccaatttccggagaaccgagattgcgacgaacaaccaggaagcggctgggttgagagctgtccccggttctccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctgatgaaaagaaacagatggttgcaaatgtggagaaacagcttgaagaagcgaaagaactgcttgaacagatggatttggaagtccgagagataccaccccaaagtcgagggatgtacagcaacagaatgagaagctacaaacaagaaatgggaaaactcgaaacagattttaaaaggtcacggatcgcctacagtgacgaagtacggaatgagctcctgggggatgatgggaattcctcagagaaccagagggcacatctgctcgataacacagagaggctggaaaggtcatctcggagactagaggctggataccaaatagcagtggaaaccgagcaaattggtcaggagatgttggaaaaccttagtcatgacagagaaaagatacagcgagcacgtgaaagacttcgggaaacagatgctaatttgggaaaaagctccaggattctgacagggatgttgcgaagatgctgtatacaacaagggatctatattcagataagatttgactatcgcaaggacagaaaaccaaacaccacatgttctcactcataggtgggaattgaacaatgagaacacttggacacagggtgagggacatcacacaccgggacctgtcgttgggtggggggatgggggagggataacattaggagaaatacctaatgtaaatgacgagttaatgggtgcagcacacc

SEQ ID NO: 458833 - DNA, 1069 bp, Homo sapiens
ccagaacacgaaggggggaaaaaacgcttctaatgatccctcagaacttgcatattttcatacgcttttctggggggaggcactaattggggcgcttttcctttgcgaacttacttatcttaaagtcggagcggaaaataaagcacgcacgcaacccaatttccggagaaccgagattgcgacgaacaaccaggaagcggctgggttgagagctgtccccggttctccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctgatgaaaagaaacagatggttgcaaatgtggagaaacagcttgaagaagcgaaagaactgcttgaacagatggatttggaagtccgagagataccaccccaaagtcgagggatgtacagcaacagaatgagaagctacaaacaagaaatgggaaaactcgaaacagattttaaaaggtcacggatcgcctacagtgacgaagtacggaatgagctcctgggggatgatgggaattcctcagagaaccagagggcacatctgctcgataacacagagaggctggaaaggtcatctcggagactagaggctggataccaaatagcagtggaaaccgagcaaattggtcaggagatgttggaaaaccttagtcatgacagagaaaagatacagcgagcacgtgaaagacttcgggaaacagatgctaatttgggaaaaagctccaggattctgacagggatgttgcgaagaggggttgttctgtgaaaaaacaatgtaacctgtctctggccccaaaggcttgaaccagaaccagccagtggaaattactcaaacacgtattgtgccttcaatgagaagccttctcactgaaagagctgccctggacggaaaatgagtagtgagatgatgctggtgg

SEQ ID NO: 458834 - DNA, 1218 bp, Homo sapiens
ccagaacacgaaggggggaaaaaacgcttctaatgatccctcagaacttgcatattttcatacgcttttctggggggaggcactaattggggcgcttttcctttgcgaacttacttatcttaaagtcggagcggaaaataaagcacgcacgcaacccaatttccggagaaccgagattgcgacgaacaaccaggaagcggctgggttgagagctgtccccggttctccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctgggatatttgcttgaagccaggatctctgaacttataccccactcatctcctgaagtccccagttagttctggaggagatggatgatgtcttaaagaggtttatgagtccaagtaagggaacaagaggagagaaccaaggtagtatataccaccaagctctgctgcctcagagatttttgtgtcgaaagtggctgatggcctcatctcttcatgatacatcacctcgcctcttctcttcagttctgcttttctccactgccggagatcgtcttgatttttgttattgttggagactacttcctttgaattgagtcccagagcctcagagtatcaggacttgtggttccagttagagttttactcatttttaattgtaattgttttagcagtagaaacatttctttgggttattagtttttgtattgggaagctgttttacaaggtaacaaaatcatccttggatgcaaagttgtaaatttccaagaaaacagatcgtgttacaatttttttcttgcctttatattttaatgtgacaattcttaacacatagaaggaaactttttgaattcagtaccttaaaaataaaactgggcagagcccggtggctcatgcctataatcccaaaactttgggaggccgaggcagacggatcacctgaggtcgggagtttgagaccagcctggccaacatggagaaaccctgtctctactaaaaatacaaaactagctgggcgtggtggcacatgcctgtaactccagctgctcaggaggctgaggcaggag

SEQ ID NO: 458835 - DNA, 651 bp, Homo sapiens
ccagaacacgaaggggggaaaaaacgcttctaatgatccctcagaacttgcatattttcatacgcttttctggggggaggcactaattggggcgcttttcctttgcgaacttacttatcttaaagtcggagcggaaaataaagcacgcacgcaacccaatttccggagaaccgagattgcgacgaacaaccaggaagcggctgggttgagagctgtccccggttctccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctgggatatttgcttgaagccaggatctctgaacttataccccactcatctcctgaagtccccagttagttctggaggagatggatgatgtcttaaagaggtttatgagtccaagtaagggaacaagaggagaggcgaggtgatgtatcatgaagagatgaggccatcagccactttgcacaaaatctctgagcagcagagcttggtgtaatacggta

SEQ ID NO: 458836 - DNA, 517 bp, Homo sapiens
  misc_feature (61)..(62): n is a, c, g, or t
gcggtaccgtgtggtctgtagctgtgcttaatcgaaggaggagccaaaaaaaaatagtcanngagcaaattggtcaggagatgttggaaaaccttagtcatgacagagaaaagatacagcgagcacgtgaaagacttcgggaaacagatgctaatttgggaaaaagctccaggattctgacagggatgttgcgaagaatcatccagaaccgcatcctgctcgtcatcctagggatcatcgtggtcatcaccatcctgatggcgatcactttttctgtcagaagacactgatgtatctgctctcccttgataaacagcaacaacagcttgttctgagtaattaagacaaaatggtcacatgaatcattctgttgcgctgacaggccccaggtgaccctctctctccctcaccgccgttgggctgaagtgcaaagagtgtaaaaatattttctattcctgtttgcatgtgggttggtttccttttcgaggtttgtcttcacccagattcgttttttaga

SEQ ID NO: 458837 - DNA, 1244 bp, Homo sapiens
ccagaacacgaaggggggaaaaaacgcttctaatgatccctcagaacttgcatattttcatacgcttttctggggggaggcactaattggggcgcttttcctttgcgaacttacttatcttaaagtcggagcggaaaataaagcacgcacgcaacccaatttccggagaaccgagattgcgacgaacaaccaggaagcggctgggttgagagctgtccccggttctccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctgatgaaaagaaacagatggttgcaaatgtggagaaacagcttgaagaagcgaaagaactgcttgaacagatggatttggaagtccgagagataccaccccaaagtcgagggatgtacagcaacagaatgagaagctacaaacaagaaatgggaaaactcgaaacagattttaaaaggtcacggatcgcctacagtgacgaagtacggaatgagctcctgggggatgatgggaattcctcagagaaccagttgataaaattacgtgaagagagggcacatctgctcgataacacagagaggctggaaaggtcatctcggagactagaggctggataccaaatagcagtggaaaccgagcaaattggtcaggagatgttggaaaaccttagtcatgacagagaaaagatacagcgagcacgtgaaagacttcgggaaacagatgctaatttgggaaaaagctccaggattctgacagggatgttgcgaagaatcatccagaaccgcatcctgctcgtcatcctagggatcatcgtggtcatcaccatcctgatggcgatcactttttctgtcagaagacactgatgtatctgctctcccttgataaacagcaacaacagcttgttctgagtaattaagacaaaatggtcacatgaatcattctgttgcgctgacaggccccaggtgaccctctctctccctcaccgccgttgggctgaagtgcaaagagtgtaaaaatattttctattcctgtttgcatgtgggttggtttccttttcgaggtttgtcttcacccagattcgttttttaga

SEQ ID NO: 458838 - DNA, 1031 bp, Homo sapiens
ccagaacacgaaggggggaaaaaacgcttctaatgatccctcagaacttgcatattttcatacgcttttctggggggaggcactaattggggcgcttttcctttgcgaacttacttatcttaaagtcggagcggaaaataaagcacgcacgcaacccaatttccggagaaccgagattgcgacgaacaaccaggaagcggctgggttgagagctgtccccggttctccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctgatgaaaagaaacagatggttgcaaatgtggagaaacagcttgaagaagcgaaagaactgcttgaacagatggatttggaagtccgagagataccaccccaaagtcgagggatgtacagcaacagaatgagaagctacaaacaagaaatgggaaaactcgaaacagattttaaaaggtcacggatcgcctacagtgacgaagtacggaatgagctcctgggggatgatgggaattcctcagagaaccagagggcacatctgctcgataacacagagaggctggaaaggtcatctcggagactagaggctggataccaaatagcagtggaaaccgagcaaattggtcaggagatgttggaaaaccttagtcatgacagagaaaagatacagcgagcacgtgaaagacttcgggaaacagatgctaatttgggaaaaagctccaggattctgacagggatgttgcgaagtaagagcaaggtagggacatatctttctctctgtgtgtttttttaaaatactatgttttcattcaattgcaatggggcatattacatgcttttgagcttctgctcttagtaccctgtgcaggacccatt

SEQ ID NO: 458839 - DNA, 661 bp, Homo sapiens
gagtacagaatgagaagctacaacagagaactcgaacagattttaaaaggtcacggatcgcctacagtgacgaagtacggaatgagctcctgggggatgatgggaattcctcagagaaccagagggcacatctgctcgataacacagagaggctggaaaggtcatctcggagactagaggctggataccaaatagcagtggaaaccgagcaaattggtcaggagatgttggaaaaccttagtcatgacagagaaaagatacagcgagcacgtgaaagacttcgggaaacagatgctaatttgggaaaaagctccaggattctgacagggatgttgcgaagaatcatccagaaccgcatcctgctcgtcatcctagggatcatcgtggtcatcaccatcctgatggcgatcactttttctgtcagaagacactgatgtatctgctctcccttgataaacagcaacaacagcttgttctgagtaattaagacaaaatggtcacatgaatcattctgttgcgctgacaggccccaggtgaccctctctctccctcaccgccgttgggctgaagtgcaaagagtgtaaaaatattttctattcctgtttgcatgtgggttggtttccttttcgaggtttgtcttcacccagattcgttttttaga

SEQ ID NO: 458840 - DNA, 1229 bp, Homo sapiens
ccagaacacgaaggggggaaaaaacgcttctaatgatccctcagaacttgcatattttcatacgcttttctggggggaggcactaattggggcgcttttcctttgcgaacttacttatcttaaagtcggagcggaaaataaagcacgcacgcaacccaatttccggagaaccgagattgcgacgaacaaccaggaagcggctgggttgagagctgtccccggttctccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctgatgaaaagaaacagatggttgcaaatgtggagaaacagcttgaagaagcgaaagaactgcttgaacagatggatttggaagtccgagagataccaccccaaagtcgagggatgtacagcaacagaatgagaagctacaaacaagaaatgggaaaactcgaaacagattttaaaaggtcacggatcgcctacagtgacgaagtacggaatgagctcctgggggatgatgggaattcctcagagaaccagagggcacatctgctcgataacacagagaggctggaaaggtcatctcggagactagaggctggataccaaatagcagtggaaaccgagcaaattggtcaggagatgttggaaaaccttagtcatgacagagaaaagatacagcgagcacgtgaaagacttcgggaaacagatgctaatttgggaaaaagctccaggattctgacagggatgttgcgaagactggcgtcagcaggaaagatcagctctgccatttgaaacacccaactgctaccttctctcagaaatcaaaagatggagtctcgctctgtcacccagactggagtgcagtggcgtgatctcagctcactgcaacctctgcctcatgggttcaagcgattctcgtgcctcagcctccccagtaccctggaagtgctcagtacatcatatgagccagagtgctggccaggaatgagaccacgctttgcctgttggtcaccgcatctccagggaactcagaggcatctccaggaaacacctgaatatgtgagctggttccttacaacagt

SEQ ID NO: 458841 - DNA, 796 bp, Homo sapiens
ccagaacacgaaggggggaaaaaacgcttctaatgatccctcagaacttgcatattttcatacgcttttctggggggaggcactaattggggcgcttttcctttgcgaacttacttatcttaaagtcggagcggaaaataaagcacgcacgcaacccaatttccggagaaccgagattgcgacgaacaaccaggaagcggctgggttgagagctgtccccggttctccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctgatgaaaagaaacagatggttgcaaatgtggagaaacagcttgaagaagcgaaagaactgcttgaacagatggatttggaagtccgagagataccaccccaaagtcgagggatgtacagcaacagaatgagaagctacaaacaagaaatgggaaaactcgaaacagattttaaaaggtcacggatcgcctacagtgacgaagtacggaatgagctcctgggggatgatgggaattcctcagagaaccagagggcacatctgctcgataacacagagaggctggaaaggtcatctcggagactagaggctggataccaaatagcagtggaaaccggtaagaattctgagagtgagcaaattg

SEQ ID NO: 458842 - DNA, 4440 bp, Homo sapiens
aggggcggggccggactcgagcggggcggggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacagaccatacagtcaatttaagaagtaggaatggctggccgggcgcggtggctcacgcctgtaatcccagcactttgggaggccaaggcgggcggatcacgaggtcaggagttcgagaccagcctgaccaacatggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcctatgcctccaacaaagcaagtaaagctgcttccgtccttctgtattctctgtgggcacacacggaactgcatcatgcctacaagaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtagatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctatcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatagtgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaaacaattttttttcaattttaaaagctgaatgaagacaacttaggttgctaacctagttcaaaatgaaattatttagataccaatttttaaaatactggagagaatttatatgtctttttccagagttctgatgataagcatttggagtgcatttattcctccagataataaatgtgtgttcagaactttttgtgttttttaaggcattaataaagccttcgataatattaaatacaaaatgagaccaaag

SEQ ID NO: 458843 - DNA, 1105 bp, Homo sapiens
cgcgagtgtcgcagctttcaacaagatctgaagcctgagtgtgtgtacgtgcgcgcgtgcgtgaggccctgccacgattaaagaccaagaccctgcctcaaagataaataaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctatcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatagtgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaaacaattttttttcaattttaaaagctgaatgaagacaacttaggttgctaacctagttcaaaatgaaattatttagataccaatttttaaaatactggagagaatttatatgtctttttccagagttctgatgataagcatttggagtgcatttattcctccagataataaatgtgtgttcagaactttttgtgttttttaaggcattaataaagccttcgataatattaaatacaaaatgagaccaaag

SEQ ID NO: 458844 - DNA, 494 bp, Homo sapiens
aggggcggggccggactcgagcggggcggggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggtccagtgctaaactgaaaccaaatcagcttcccctgcgtaggagacacaggaggcatattagatattctttcttatcctctgagaatggccagctaggaagagagcaagcagatacaactcttccataaatggagggaatggagccatgaacaga

SEQ ID NO: 458845 - DNA, 4459 bp, Homo sapiens
aggggcggggccggactcgagcggggcggggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacaggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcctatgcctccaacaaagcaagtaaagctgcttccgtccttctgtattctctgtgggcacacacggaactgcatcatgcctacaagaaggtaagaacatgaacaaggaatgtgtcatagttaacagagccaggtaataatggcccacttgacttgaccctgggaagaaatcgctaaaaaactgcattttcttgtgtgccagttttgttacctttcacgtttctgtttgcttattccaaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtagatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctatcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatagtgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaaacaattttttttcaattttaaaagctgaatgaagacaacttaggttgctaacctagttcaaaatgaaattatttagataccaatttttaaaatactggagagaatttatatgtctttttccagagttctgatgataagcatttggagtgcatttattcctccagataataaatgtgtgttcagaactttttgtgttttttaaggcattaataaagccttcgataatattaaatacaaaatgagaccaaag

SEQ ID NO: 458846 - DNA, 2860 bp, Homo sapiens
aggggcggggccggactcgagcggggcggggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacaggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcctatgcctccaacaaagcaagtaaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtactttcgccgcccgccaaattaaacttggatttttcatcttgtgaaagcagtccttgttcctatggcctaatgaacaacttccaggtaatgagtatggtgtcagatttacaccactaatttctgca

SEQ ID NO: 458847 - DNA, 612 bp, Homo sapiens
cctgacttcatggatggctgctgcggagtagcagttgaggagcgaagaggtcttacagaacacccacaggccgcatccagaagcctcactcattctccctgatctcagaatgtccttttcttttcagctatgcctccaacaaagcaagtaaagctgcttccgtccttctgtattctctgtgggcacacacggaactgcatcatgcctacaagaaggtaagaacatgaacaaggaatgtgtcatagttaacagagccaggtaataatggcccacttgacttgaccctgggaagaaatcgctaaaaaactgcattttcttgtgtgccagttttgttacctttcacgtttctgtttgcttattccaaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctt

SEQ ID NO: 458848 - DNA, 4308 bp, Homo sapiens
aggggcggggccggactcgagcggggcggggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacaggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcctatgcctccaacaaagcaagtaaagctgcttccgtccttctgtattctctgtgggcacacacggaactgcatcatgcctacaagaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtagatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctatcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatagtgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaaacaattttttttcaattttaaaagctgaatgaagacaacttaggttgctaacctagttcaaaatgaaattatttagataccaatttttaaaatactggagagaatttatatgtctttttccagagttctgatgataagcatttggagtgcatttattcctccagataataaatgtgtgttcagaactttttgtgttttttaaggcattaataaagccttcgataatattaaatacaaaatgagaccaaag

SEQ ID NO: 458849 - DNA, 2654 bp, Homo sapiens
gctcaacagcagcctgaaaaccattctagaatgacctatgcttaattctctgaattttctctcactgggagaaatatcaagttaggggtgtggagtgttattaggaagaaataatcattatgggctaaaagttaagtgattagaaattatatatatttgcttttaaaatttctatttcaagggcttcttatgcaaattatgagcctttctagacagtatttctggtctcctggtttgagtgtgaaattatagccatcacctgacatgcattaattctggattccttttgtgtgtggtcagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcctatgcctccaacaaagcaagtaaagctgcttccgtccttctgtattctctgtgggcacacacggaactgcatcatgcctacaagaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtagatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctatcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatagtgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaaacaattttttttcaattttaaaagctgaatgaagacaacttaggttgctaacctagttcaaaatgaaattatttagataccaatttttaaaatactggagagaatttatatgtctttttccagagttctgatgataagcatttggagtgcatttattcctccagataataaatgtgtgttcagaactttttgtgttttttaaggcattaataaagccttcgataatattaaatacaaaatgagaccaaag

SEQ ID NO: 458850 - DNA, 2598 bp, Homo sapiens
aggggcggggccggactcgagcggggcggggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacaggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccagtgagtattgggcctgatttcctactttttaaaataatgatattgtagacatacctacattcaattcagagatgaaacagtgagggaagagaaaaaggtttcttattttagtaaagacaattctcagaaattacagagggcttcggtctcagcttatgcaaagtcaagtcaggctgcttgactgacaagtcaagtcagtactctttcagttacagatctcagaatcctgcctcaagctggtttaagcaaaaaagaggaaatttttggcttatggcactgaaaactccagggtgggccttctttctgtcgtgactggacttaggtgcaccagtgattacagttgactttcttcatctccgggcttggttttcctctgctgggtttgttctcaaaggctctctccatagggtaacaaagacagccatgaattatttcaggctcacgttttatcagcccaatgtgtcccccac

SEQ ID NO: 458851 - DNA, 740 bp, Homo sapiens
gcccatggacaatggcttccccggcaaagggcccggttccaccgggtggctcccgggtaccggggagacaaggcgccggggcccgttgggcctggcgggagctgcggcgccccgacggacggacggacggacggactgactcaccgacggcgcgcgctaacggctcggctccacacgctctcgccgcggctgcgcctgcacctgcctgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaa

SEQ ID NO: 458852 - DNA, 559 bp, Homo sapiens
ttgctcccacttgcctggctggagaagttgatgcttattcctacagatccttaggaacagctcaccaggaagtaggaggaagagagaagaggaggcagggaaagtgggagggcactgatgagacatggacgtcttctggctgttggaatttccctgttcctgctgcaggaggccttaccaatattctgtcattcttccccctcttgtctgatataaaaactttctttttcttgtaattgctttcttacaaagtacactcatcagccccaagaggctgctcctaagacttctctttgcttgtgttttgcacacaatctgttccttctgcggcagagctggggtcaccagccctcatgtacttgtgacttctcccctgccacagggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaa

SEQ ID NO: 458853 - DNA, 644 bp, Homo sapiens
  misc_feature (48)..(48): n is a, c, g, or t
  misc_feature (52)..(52): n is a, c, g, or t
  misc_feature (68)..(68): n is a, c, g, or t
gcctcgaaaccttccgcctcggaacgaaagccgggagagtttttacgngccngcaagtgccggcccanaaggaattgcgcaagataagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaa

SEQ ID NO: 458854 - DNA, 2162 bp, Homo sapiens
  misc_feature (48)..(48): n is a, c, g, or t
  misc_feature (52)..(52): n is a, c, g, or t
  misc_feature (68)..(68): n is a, c, g, or t
gcctcgaaaccttccgcctcggaacgaaagccgggagagtttttacgngccngcaagtgccggcccanaaggaattgcgcaagataagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaacaacccccttcccctctgcttatctgcaatgtcaccacctgttgcttccccgttaccgccatgctgcgtggagcatgcacctattccagtggccctgtgactgtcagctccttaagaagcaccaggggcccttagcccctttggatcccccacatccttccctccatctccctgttccccagagcaaaggctgctgcaggggagacacctcagctgccttccaagcagacagacaagtctttgtgcccagggagctggttgccacggaaacccccaatttcctttccagtggggactggctgcaggggcttctcccttctcaggagtatcacagagcaggtctcatcaagccacccattgtttcctaaggacctgcttcgagcctcttatcgtgggctcggatcccctttcaggagcagtgccccagcaggaagcgtgggggtgtgctgatctcccaccctccccaggcagagccctgctgggcaagtcagcagctggagcaaggaccgagcacctgcctacccctgcccccatggctctgtccccactcctcctcaggactctgcccacacgctgtcctctgtggcccacctctttggtgtgccacacccatgccttcttcctagcctctataagatatcctttccctcctatttggggctggtgatcccctgaggccttggggacatggtgctggggtggtggtgctcctgggttccaggtgttacattaagtcagagctggagttcccccttcctctgcctgaggttctaatgggtcctcttcctttctccaccctgcttacccaacctgaggtaagaccagtcacactggctcctccctcctagagggggtcagggggagggtgtatattgacatgaacagggatagagggtaaactggctccctgaatatgccagccttaacctccattccactgccagctccccttcaaagaggaggagctgggcttccctaacctctgcaggaggcagggcctccaggcctaggtgcagcctggccctgggatgggatgtggggagtgaatggtgaggatctgcattggtgggaggggtgtccgctgccctggagaagggttaattcagggagcagtggacttcacactcccatccaccctcctccaagcctgtggaatcctttaatcaagttgggtgctgaaatttcagctctgaaatgccgcctttgtgctggcatccaggcagccgccccagagtgcgggggtcactttctcggccccatttctctaaatggtctctttgttccctgctgggctgctcagtatcagatgtgattaaagggagatggggtttgggctggggaggaggggaattgggggttaacccttaggggatagagtgcaagggaaatgggacagaaggggtgtttttcctcctgtcttcctcttcccattctcctcttttggggagtcccctgctattcagctgtctgggcctggcttttgacttctcttgaataaaatgtcccggtcaccactat

SEQ ID NO: 458855 - DNA, 1101 bp, Homo sapiens
  misc_feature (48)..(48): n is a, c, g, or t
  misc_feature (52)..(52): n is a, c, g, or t
  misc_feature (68)..(68): n is a, c, g, or t
  misc_feature (692)..(692): n is a, c, g, or t
gcctcgaaaccttccgcctcggaacgaaagccgggagagtttttacgngccngcaagtgccggcccanaaggaattgcgcaagataagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaacagcgttggacataccgagtaggtttcctacaattacagctctaacanaataggctgtcccgaaccccgtggtaatagaattggttaacctttataccaagaaggtggcgaaagcacaaatttgcttgttggtgtgtgcccaggcagacttcgaggggtcgtgcggtaagacctaaagtcctaattgagattgtcaaaaaaaggaactgtaggagggctatggtggtcatgggtctaaattgtgtcgtgaaagggttcaggggttcctatgggagcgaaatggtgggaagggtgaggcaggcagggtggaagtataaaatgacttttggtataaatgcacgggttaaaaaaaacggggttttggggaaaggtaaagacgttgtctggcctttaaggattggtcttggtatgggttattatagtgaaaggaagaggaggaaagaaaaaaaagagagag

SEQ ID NO: 458856 - DNA, 757 bp, Homo sapiens
  misc_feature (48)..(48): n is a, c, g, or t
  misc_feature (52)..(52): n is a, c, g, or t
  misc_feature (68)..(68): n is a, c, g, or t
gcctcgaaaccttccgcctcggaacgaaagccgggagagtttttacgngccngcaagtgccggcccanaaggaattgcgcaagataagctaggagccgcgcgagtcgtagtgtcgctgtttgcgggtctccgcgcgggaccggggcgcagcggggtcgctgaggcgagggtgtcatgtcagacaacgaggacaagtgagtgcgggagcggagtggcctttgcggcaaccttggaaggggcggatgagttttgatggcgacgactttgatgatgtggaggaggatgaagggctagatgacttggagaatgccgaagaggtcagtattcagcctcaggctcccacctctgcagcccaagctgccaaatcgtctgacagggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaa

SEQ ID NO: 458857 - DNA, 2077 bp, Homo sapiens
ttgctcccacttgcctggctggagaagttgatgcttattcctacagatccttaggaacagctcaccaggaagtaggaggaagagagaagaggaggcagggaaagtgggagggcactgatgagacatggacgtcttctggctgttggaatttccctgttcctgctgcaggaggccttaccaatattctgtcattcttccccctcttgtctgatataaaaactttctttttcttgtaattgctttcttacaaagtacactcatcagccccaagaggctgctcctaagacttctctttgcttgtgttttgcacacaatctgttccttctgcggcagagctggggtcaccagccctcatgtacttgtgacttctcccctgccacagggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaacaacccccttcccctctgcttatctgcaatgtcaccacctgttgcttccccgttaccgccatgctgcgtggagcatgcacctattccagtggccctgtgactgtcagctccttaagaagcaccaggggcccttagcccctttggatcccccacatccttccctccatctccctgttccccagagcaaaggctgctgcaggggagacacctcagctgccttccaagcagacagacaagtctttgtgcccagggagctggttgccacggaaacccccaatttcctttccagtggggactggctgcaggggcttctcccttctcaggagtatcacagagcaggtctcatcaagccacccattgtttcctaaggacctgcttcgagcctcttatcgtgggctcggatcccctttcaggagcagtgccccagcaggaagcgtgggggtgtgctgatctcccaccctccccaggcagagccctgctgggcaagtcagcagctggagcaaggaccgagcacctgcctacccctgcccccatggctctgtccccactcctcctcaggactctgcccacacgctgtcctctgtggcccacctctttggtgtgccacacccatgccttcttcctagcctctataagatatcctttccctcctatttggggctggtgatcccctgaggccttggggacatggtgctggggtggtggtgctcctgggttccaggtgttacattaagtcagagctggagttcccccttcctctgcctgaggttctaatgggtcctcttcctttctccaccctgcttacccaacctgaggtaagaccagtcacactggctcctccctcctagagggggtcagggggagggtgtatattgacatgaacagggatagagggtaaactggctccctgaatatgccagccttaacctccattccactgccagctccccttcaaagaggaggagctgggcttccctaacctctgcaggaggcagggcctccaggcctaggtgcagcctggccctgggatgggatgtggggagtgaatggtgaggatctgcattggtgggaggggtgtccgctgccctggagaagggttaattcagggagcagtggacttcacactcccatccaccctcctccaagcctgtggaatcctttaatcaagttgggtgctgaaatttcagctctgaaatgccgcctttgtgctggcatccaggcagccgccccagagtgcgggggtcactttctcggccccatttctctaaatggtctctttgttccctgctgggctgctcagtatcagatgtgattaaagggagatggggtttgggctggggaggaggggaattgggggttaacccttaggggatagagtgcaagggaaatgggacagaaggggtgtttttcctcctgtcttcctcttcccattctcctcttttggggagtcccctgctattcagctgtctgggcctggcttttgacttctcttgaataaaatgtcccggtcaccactat

SEQ ID NO: 458858 - DNA, 659 bp, Homo sapiens
  misc_feature (48)..(48): n is a, c, g, or t
  misc_feature (52)..(52): n is a, c, g, or t
  misc_feature (68)..(68): n is a, c, g, or t
gcctcgaaaccttccgcctcggaacgaaagccgggagagtttttacgngccngcaagtgccggcccanaaggaattgcgcaagataagctaggagccgcgcgagtcgtagtgtcgctgtttgcgggtctccgcgcgggaccggggcgcagcggggtcgctgaggcgagggtgtcatgtcagacaacgaggacaagtgagtgcgggagcggagtggcctttgcggcaaccttggaaggggcggatgagttttgatggcgacgactttgatgatgtggaggaggatgaagggctagatgacttggagaatgccgaagaggtcagtattcagcctcaggctcccacctctgcagcccaagctgccaaatcgtctgacaggaaggccaggagaatgtcgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaa

SEQ ID NO: 458859 - DNA, 940 bp, Homo sapiens
ccaaaaagtagagagagaaaatagaaattgaaatgaggtgcactgggcactgaggcaaggctctggggttggagcagttagaatggtgtgcctttgcacatgtctccctttccaccaggacattctgctgtggccgctggactccggagtctgtgataggcctctgccagggaagatctctggcagtgcccctacacaccactccctactgtgcctgcctacctagaagatgacgtttctaggtggggaccaggatgccgttccaccctcactgcctgttgggcccttctccctgggtttgtagtctccctaacacctgtccctatccctacaggatgtgtgcccctgtgatggtggagctggagggggagacagatcctctgctcattgccatgaaggaactcaagtaagtcactcaaatcatggttcacttctccaaatctctgggaggcatctgttgggctctctgttgcaccctttgctcccacttgcctggctggagaagttgatgcttattcctacagatccttaggaacagctcaccaggaagtaggaggaagagagaagaggaggcagggaaagtgggagggcactgatgagacatggacgtcttctggctgttggaatttccctgttcctgctgcaggaggccttaccaatattctgtcattcttccccctcttgtctgatataaaaactttctttttcttgtaattgctttcttacaaagtacactcatcagccccaagaggctgctcctaagacttctctttgcttgtgttttgcacacaatctgttccttctgcggcagagctggggtcaccagccctcatgtacttgtgacttctcccctgccacagggcccgaaagatccccatcatcattcgccgttacctgccagatgggagctatgaagactggggggtggacgagctcatca

SEQ ID NO: 458860 - DNA, 831 bp, Homo sapiens
  misc_feature (48)..(48): n is a, c, g, or t
  misc_feature (52)..(52): n is a, c, g, or t
  misc_feature (68)..(68): n is a, c, g, or t
gcctcgaaaccttccgcctcggaacgaaagccgggagagtttttacgngccngcaagtgccggcccanaaggaattgcgcaagataagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaaaaaaaaaaaaaaaaagaaaagaaaaactgccggggacttataatgtgggggggggggaaaaacagggttgggaaggggccagtgggaataggggttcccgggcaccaggttttttgttccccaggggggaaattggcggggccccattatgaggggcggattatttggaaaacccggtacccggttg

SEQ ID NO: 458861 - DNA, 697 bp, Homo sapiens
  misc_feature (48)..(48): n is a, c, g, or t
  misc_feature (52)..(52): n is a, c, g, or t
  misc_feature (68)..(68): n is a, c, g, or t
gcctcgaaaccttccgcctcggaacgaaagccgggagagtttttacgngccngcaagtgccggcccanaaggaattgcgcaagataagctaggagccgcgcgagtcgtagtgtcgctgtttgcgggtctccgcgcgggaccggggcgcagcggggtcgctgaggcgagggtgtcatgtcagacaacgaggacaagtgagtgcgggagcggagtggcctttgcggcaaccttggaaggggcggatgagttttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaa

SEQ ID NO: 458862 - DNA, 2177 bp, Homo sapiens
  misc_feature (48)..(48): n is a, c, g, or t
  misc_feature (52)..(52): n is a, c, g, or t
  misc_feature (68)..(68): n is a, c, g, or t
gcctcgaaaccttccgcctcggaacgaaagccgggagagtttttacgngccngcaagtgccggcccanaaggaattgcgcaagataagctaggagccgcgcgagtcgtagtgtcgctgtttgcgggtctccgcgcgggaccggggcgcagcggggtcgctgaggcgagggtgtcatgtcagacaacgaggacaagtgagtgcgggagcggagtggcctttgcggcaaccttggaaggggcggatgagttttgatggcgacgactttgatgatgtggaggaggatgaagggctagatgacttggagaatgccgaagaggtcagtattcagcctcaggctcccacctctgcagcccaagctgccaaatcgtctgacaggaaggccaggagaatgtcgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaacaacccccttcccctctgcttatctgcaatgtcaccacctgttgcttccccgttaccgccatgctgcgtggagcatgcacctattccagtggccctgtgactgtcagctccttaagaagcaccaggggcccttagcccctttggatcccccacatccttccctccatctccctgttccccagagcaaaggctgctgcaggggagacacctcagctgccttccaagcagacagacaagtctttgtgcccagggagctggttgccacggaaacccccaatttcctttccagtggggactggctgcaggggcttctcccttctcaggagtatcacagagcaggtctcatcaagccacccattgtttcctaaggacctgcttcgagcctcttatcgtgggctcggatcccctttcaggagcagtgccccagcaggaagcgtgggggtgtgctgatctcccaccctccccaggcagagccctgctgggcaagtcagcagctggagcaaggaccgagcacctgcctacccctgcccccatggctctgtccccactcctcctcaggactctgcccacacgctgtcctctgtggcccacctctttggtgtgccacacccatgccttcttcctagcctctataagatatcctttccctcctatttggggctggtgatcccctgaggccttggggacatggtgctggggtggtggtgctcctgggttccaggtgttacattaagtcagagctggagttcccccttcctctgcctgaggttctaatgggtcctcttcctttctccaccctgcttacccaacctgaggtaagaccagtcacactggctcctccctcctagagggggtcagggggagggtgtatattgacatgaacagggatagagggtaaactggctccctgaatatgccagccttaacctccattccactgccagctccccttcaaagaggaggagctgggcttccctaacctctgcaggaggcagggcctccaggcctaggtgcagcctggccctgggatgggatgtggggagtgaatggtgaggatctgcattggtgggaggggtgtccgctgccctggagaagggttaattcagggagcagtggacttcacactcccatccaccctcctccaagcctgtggaatcctttaatcaagttgggtgctgaaatttcagctctgaaatgccgcctttgtgctggcatccaggcagccgccccagagtgcgggggtcactttctcggccccatttctctaaatggtctctttgttccctgctgggctgctcagtatcagatgtgattaaagggagatggggtttgggctggggaggaggggaattgggggttaacccttaggggatagagtgcaagggaaatgggacagaaggggtgtttttcctcctgtcttcctcttcccattctcctcttttggggagtcccctgctattcagctgtctgggcctggcttttgacttctcttgaataaaatgtcccggtcaccactat

SEQ ID NO: 458863 - DNA, 907 bp, Homo sapiens
actgaaaataattttgctctaccctctaatattctgctctgttaaaggaattttgagttaatttatttcccattttctcagtttaaattttttttttattttctgcagtaaaaactagattttcatatgcctttccaaaggaatttccttataggatgaatcatgtaagtatatgatataaaatggaacaattatcaaagctatatataaactagctctattttatattagactaaatttaatagtttcctagaaatggcagtttcaaatattacataaatacagacattattctaaattaaagctaaatagcttttaccatttaaaaaaaatacttcatagtggcgattatcaaccctggctgctcattaaatcaccttgggaacttgtaaataatactgatgttggatcctttccagaacaacaaaatcagaattttcagccttggggctcccaacattggtactgtgtaaaaggtcccaggtgatactactatttagctgggattaaaaactaatggaacaatatgaaatataaggtgaatttctattgacattttaataggtatgtcctttttccaccttgcaagggatttgtttattctctttaagttacattttttaaattaagtagaaataattgtatttttgcatttgctgagtagaaagtatactggaaaatctgatggttttacaggatattttaaataaaagtgagtaataagaatgattgtgagaagctggcttttccttacaaggattaaaatccttataatcataattgcatttctaatagtaattttttattgcagatatttattttaatataaactatgtttattgtctggatttttaaaactttttagtaaaaatttttgataaattactataatgtctgtaatttatgt

SEQ ID NO: 458864 - DNA, 484 bp, Homo sapiens
catacctatatatttcttaacacatttgcaaatcctagaattagaccactgtgactcacatagagcatgtgtaggttttttcctttgttaaaaatgaacataattatgatttaaccacatggaagttactgttcaatgttaatattataatgataccagaagatacatttaaaatttcattatttgccttttagttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtatgtaagtgcaaaaagtatatctgctttaaggatgtaattctaaagaaagctccagagtacatagatttttttttttttagttta

SEQ ID NO: 458865 - DNA, 2593 bp, Homo sapiens
tttttccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 458866 - DNA, 2539 bp, Homo sapiens
tttttccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagcattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 458867 - DNA, 2539 bp, Homo sapiens
tttttccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 458868 - DNA, 2495 bp, Homo sapiens
tttttccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 458869 - DNA, 2371 bp, Homo sapiens
tttttccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 458870 - DNA, 2537 bp, Homo sapiens
tttttccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 458871 - DNA, 1562 bp, Homo sapiens
ctctctggaggaaatatacaatcagatgaggtagttctgctttcagtaataatatgatttacatttctataggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 458872 - DNA, 1416 bp, Homo sapiens
  misc_feature (35)..(36): n is a, c, g, or t
atatcattaaaaacaaattggcagaggaaggaganncctagttggtgacgacctcttaatttccaccgctacacattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 458873 - DNA, 1337 bp, Homo sapiens
ttgttttgtatagttgtgccacagaataatgaatttaaaagtcagtaggcttatcagggtgtaaaaatggatcttttaattggtataaaatctctttcttccccatttgaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 458874 - DNA, 1182 bp, Homo sapiens
cactatggaattcttcggaatgttttaagattggctgtagctagagttctgacttccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 458875 - DNA, 1718 bp, Homo sapiens
tttttccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatgtaagtatatgatataaaatggaacaattatcaaagctatatataaactagctctattttatattagactaaatttaatagtttcctagaaatggcagtttcaaatattacataaatacagacattattctaaattaaagctaaatagcttttaccatttaaaaaaaatacttcatagtggcgattatcaaccctggctgctcattaaatcaccttgggaacttgtaaataatactgatgttggatcctttccagaacaacaaaatcagaattttcagccttggggctcccaacattggtactgtgtaaaaggtcccaggtgatactactatttagctgggattaaaaactaatggaacaatatgaaatataaggtgaatttctattgacattttaataggtatgtcctttttccaccttgcaagggatttgtttattctctttaagttacattttttaaattaagtagaaataattgtatttttgcatttgctgagtagaaagtatactggaaaatctgatggttttacaggatattttaaataaaagtgagtaataagaatgattgtgagaagctggcttttccttacaaggattaaaatccttataatcataattgcatttctaatagtaattttttattgcagatatttattttaatataaactatgtttattgtctggatttttaaaactttttagtaaaaatttttgataaattactataatgtctgtaatttatgt

SEQ ID NO: 458876 - DNA, 781 bp, Homo sapiens
tttttccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatggtaaacttttttaaaaattggttcaaattgtatagttggttacctctgaataaaaatgtttttgtgtgg

SEQ ID NO: 458877 - DNA, 344 bp, Homo sapiens
gaacatcttaaattaagacaacaagttattgccactgctacggtatatttcaagagattctatgccaggtaggattgtttttattttatttatttgaactcttatctaatgttgatgaaccttagcacagtgtaaatgaatcatgtgtctaccatagagttatcttgatttttttcccagtgtgttttctgtatgaatgatatttaactttgttttatcatattttaggtattctctgaaaagtatagatcctgtattaatggctcctacatgtgtgtttttggcatccaaagtagaggtataaaacaattttctgttcttcatcaaagacgtagaaagtgtat

SEQ ID NO: 458878 - DNA, 2740 bp, Homo sapiens
tttttccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgtaaaaaaaaaagtcttgaatttatctttttgaatttgcctgatgttgttttttgagaattcttcttcctttagttaagtgttaaagccttttataggttgtcaagggggtaatttcaaatcattacaaacagattttaaatagaaaatt

SEQ ID NO: 458879 - DNA, 2661 bp, Homo sapiens
tttttccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagaaattccctgagtgattctccactagtggcagggcctgaagctgcaagatgatggtggacaagataagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 458880 - DNA, 2734 bp, Homo sapiens
tttttccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatcctaaaagaagggaccactttgccttgctcaaatcccttgagcagtcatggagtttcttatctggaaaaggtaacgagtgtggaagacaagacaattctggaaaaacaaacgaaaagattatgaaaggccattgtcttagtttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 458881 - DNA, 2040 bp, Homo sapiens
ttcggattcttggtttagctaggccgcggggggtcggatagagtgggcacagtttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgta

SEQ ID NO: 458882 - DNA, 1865 bp, Homo sapiens
tttttccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggattgttgcttgatagtgtatcatccttatagacctttgctccagtatgtgcaggacatgggccaagaagacatgttgcttccccttgcatggaggatagtgaatgatacctacagaacggatctttgcctactgtatcctcctttcatgatagctttagcttgcctacatgtagcctgtgttgtacagcagaaagatgccaggcaatggtttgctgagctttctgtggatatggaaaagattttggaaataatcagggttattttaaaactatatgagcagtggaagaatttcgatgagagaaaagagatggcaaccattcttagtaagatgccaaaaccaaaaccacctccaaacagaaattccctgagtgattctccactagtggcagggcctgaagctgcaagatgatggtggacaagataaggcaataatcctattgccaaagttactggtattttcagttttagttatttttaagtattcagcatttttattttaagtattcagcattttccaggaaattaccatatttcttgctgacttataaaggtttgctgtatttatatatgattttattatgcctttggacaacagttttggtttttttttttttgaagaacacttcttgtttttcataaatagtaggaataggattttatatgtaagatttaattttataggaaatttgtttagaagaagctgtaatctctatgttgagtgatacctgtaataacaatgaaatcccataccctaatttaaagtttttgagtatatatggacactaacttccagaatgcttgttatatgtgagggcacaaagttatataagaataaaaacataaaaccaatgt

SEQ ID NO: 458883 - DNA, 1433 bp, Homo sapiens
tttttccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatcttaaattaagacaacaagttattgccactgctacggtatatttcaagagattctatgccaggtattctctgaaaagtatagatcctgtattaatggctcctacatgtgtgtttttggcatccaaagtagaggaatttggagtagtttcaaatacaagattgattgctgctgctacttctgtattaaaaactagattttcatatgcctttccaaaggaatttccttataggatgaatcatatattagaatgtgaattctatctgttagaactaatggtaagtaaatcttctgtgattaatagattaaaacatttttaaattaaatgaagttggaaattatttaaagaaatgattttagagaggtacattttaaaaccatccacctaatatgtgatggtgaaatcatggtagcctatttatattagcacctagagtctctctgaagcctgtaaaataatttgtatatcctacttaggatgggaaaatttttctgttctatagtaagtaactataatgaaaggattacaaacagacaagtcaggacattaaaccaccataaattatgtgcacaatttgtgtgtgcgtgcagtgttatttaaagatagattatgtctttggcagaattctgctcctccagttgggaattatgaatttataggctaataagaggtttcagtgtgttgcagatgtgacacttt

SEQ ID NO: 458884 - DNA, 839 bp, Homo sapiens
tttttccctgagaacaaagtcatcttcatttatttctctttccaatcacaggaaaaataagtcacaaaaccttgtactttattacaatgccacattgttctgtttttgaagtcctggaagaggtaataacagaaccccgtatctgagccacttcgcctaggttagacccactcagcaactcccgtgctgaagacaggagaccgagcggcttgggcccccggccagaattctcaagacgctctcgcgagagccttccaaccgccgcgagctctcgtgaacactagttctcttcaatctcagcacctccaagggtcagcacctcccctccggctccctccgctaccgcgggccggaacttttgtcgataggaacgggtttgcacagttgagtgttgtcggccggcgtgaaggagactagggggccatcctcttcctttcgccgtcgccgccgcggagcggagtcgagccgagctgatttgatcgaggagcgcggttaccggacgggctgggtctatggtcgctccgcgggccgctccgccggctggtgcttttttatcagggcaagctgtgttccatggcagggaacttttggcagagctcccactatttgcaatggattttggataaacaagatctgttgaaggagcgccaaaaggatttaaagtttctctcagaggaagaatattggaagttacaaatattttttacaaatgttatccaagcattaggtgaacatctcaaaaatgacaacaagaacaacaaaagttaatgataatatagaagcataaatttcctgtgaatgttcaattacacataataaacattattgaattgtcccca

SEQ ID NO: 458885 - DNA, 1113 bp, Homo sapiens
tttgagacaaggtctggctctgttgcccagactggagtacagtggtacaatcttgtctcactgcaatctctgcctcccaggctcaagccatcctcccacctcagccttcctagtagttgggactacaggcgcacaccaccatgcctaggtaatttttgtattttttttttgagagatggggtgttgctatgttgcccaggatggtctcgaactcctgagctcaagcaatcctcctgcctcagcctcccaaagttctgggattacaggcaggagccaccaccgtggcaatgatgattttataaatgagctcttgctctctttttggagaaaaagccgagaaattcctctgcctttctttgccccatcagtttatctttgccgtgtcagggctctgaaagccacaaaaccatcacccctcctcctgctggctttgtctccagcccgctctccaggtggaggctctgactgttagggaattctggctccgtctcttacacactgagaactccatgagctggtaccttagccactttttctagtgcctcatagctaatcattgggaagttcttggtcattttttggttggaaaattaaaaggaaaagatgtgagttgatgaaagataaaattttactataaaattcaagccatcttcttaagattcccctgcatgtggctgcctcgtacccaccgctgtccctggtgtgcatggcgagtgcagcaagtcacacctgtgtcagcagcatcgtcctctgccttgtacagcacagcttggcctggggcctgctggggcgctcagaaaacagcaagctgtgtgtgctgtgtttgttaacatagagtgtgatgactgatcattgtctatgccagtagcagcttttagtgaaaatacaggtccccaggcaaggcctgaagccccagtttttactttattttgattacaggatcataacaataaagtaattctggatctccatttccttggtaatcactgtgctgtgatagtgtgtgcaccagcgaaacatggcattcctacagtgagattatatcaagaaagcacttattaaacatcatgttttattttgttttttttagacagagtctcaccctgtcaccca

SEQ ID NO: 458886 - DNA, 2474 bp, Homo sapiens
cggctcccgggccccctcgctcctcccctctggcccctccgagcgctgggggtgcttccctccccgcctcctcgcactcccacctcgcgggcacgccggtgggctgtgccgccatgccccagccacaggctgctcacgggcctaggcgcggcggcccgagataggggcccctgagcctcccgggggaggagagaggcagcgagccgcgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgggtcagtactaacatagcatttcgttacctcttaagggttgagtttacaactccaaattcaagcatttcatctcaagagttgtagaagtttattaccacctcacttcagtatacttttcaaagtaatgaagtagcatcatcacattataaattagagtacctatacaaggctttttttttttccccagcatttccaaaactacctagtcccattgctttaaatcgtatctgtaccaagtgttggcaaactatgaaccacaggccaattccagcctaccacctttatttgtaaatcaagtattactggaacacaaccaggctcatttgctgacatattgtttgtggatggcagagttgagtggttgaaacagactgtatggtgtgcaaagtcagaatgtgtgctgtacggactgctgtgaaaaacatctgccaaagtctgatctgtatacccataactccctcctgcttgatatttcccataaatgtataaagggcatttcacatttaacaaggccaagacagaactcttgatttctaactccttgtctgaatcctgcttctccagcctttctcccatttcagtaagcatcatcattatcccctaatttctcaagcaaaatctctgaggattgttcttaatcttttttccttaccactcttcatctccctcgtagttaatccttaagtcctgtcaactctgcctataaaatatatccctgtctacttttctaatctgtactgtagccaccctactctaagtcaccaccatcttttgccttgactactgcaataaccttcaaagtagcctctgattgcattcttcccctaatccattttccatgtagcagccaaaatcatcttttcttttttaattaagtcagattatgtcactgttttaagctatagattcttaacattctttattcatacctaaaatctataggccttgctatgccttctaaagccctacacgatatgacttctgcctaatccgtcac

SEQ ID NO: 458887 - DNA, 6097 bp, Homo sapiens
  misc_feature (3817)..(3817): n is a, c, g, or t
cggctcccgggccccctcgctcctcccctctggcccctccgagcgctgggggtgcttccctccccgcctcctcgcactcccacctcgcgggcacgccggtgggctgtgccgccatgccccagccacaggctgctcacgggcctaggcgcggcggcccgagataggggcccctgagcctcccgggggaggagagaggcagcgagccgcgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagtgatttcctagtaccggactacttaaaccaggaacaagaagagacccttgttcaatatgatcttggagaacacggttttgaaagcaactcctctgttcaaatgcctgtcatttcacaggtctcctcaacccagaattgtgaaagcacttttcccttggggtctcttggtgggctggcagaaaaagaggaagaagtgccagagcagccaaagagcagtgcttgtgctgaggcaaccagagatgaccccccaaaatcagagctgtcttctataactattgagtagttttgtgatttggcttcagttttgttttttggaaagtgcctgtgcttggtcttgtacatttaaatttaatttaattttttaaacaaaaaagccgggtgggagggagggggagattgggaaagaatttccctttttactttctgagccctgaaactgattttatttttcctaactgagagattgcttctgtaagtacacaataacatgatgttgaaacagaaactatgagacttaaggagaactggttgacttaaaacatataccagttccttcttccattgttaaaagtaggctaacaacagatcattagctagagaggaaatcagatgattattgaccttcttgagacaagagggtacatgagaaactaattactaaacagcttgacaaatggcctgagtagatacttactgctgtacacaggatgttgtataatattttgtaaagcctgttgtttttggaagtatttatggtaagctttcttaaaaattattatggtaaatacttctgaaatccggcgtacttttctttaagctttgtcatttctgttatgatttttcatggtgaaattttggtactgagatgggcattctctgtacctttatagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcccatatgacagcgatacattgtccttacatatttatttttagacattgcaaagttattaaaaacagttaactatagtttttacacaacgtaggcaacaatgaagagtatagactgtaagattttcatctatgactcataaatctgggagaaaaaaattattaagactaatgagaaactgaaaaccttaaactaatgaatattatttctgctgctaaaaatatgaaactttctggtctgtagttgaaatttgtatgatcctctagacttgggtatacttttcatctggtgccattaaagcatctctaatattgatcctaaatatttgtaagtccatgagcagtgaactttggaataagtttctgtgtagatacccaaagtttaataattatgagagcacctgatttgatagacagaaaatacagttctttagtcaaaacacaagatctgaattttgttcaggtgctagaccatactaaatgtatatatttttaattatagtgatttgtttcatntttttagattggctaattctgtaattttttccccaaaaacatgtgaagaaaggaaaagtaaattaaattccttagaactgttttaggttaagattctctgtgtctgcccatattctgcagtccttaacttgttttcaactctttacctcactcatgaacttgtttttacccatttgctgccaaacataggtgtgttcccttcaggagaatcagcatatacaggttatgataggctcccaccatttatgcttcttcactgatagggttgcattactttctgcagcagactataatacttcatatagtactgctgtgtctcaactggaaaggtcaggaattttaatgttacgttgtggtctttgaaaactgttaggcctagcaatagataaatctcaaaattaattttaaaatctgtattgacaagaataggtaaaattatgaccaggaatcattgttacccttagttccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcagaataaattgcctttttaaaaccaagcattttgtacaagcttttattttcagttttttaactaccaaataggtgtgatgtactttagaagtaaacaaagatgttcacccatgataatggatgttaaagctcctgcagttgttcttttcgtgtttaaagggtatattctaatagtggaagcatcaaacatgtcagtgatttcatctcattcagaaataaagagattaatattggtctttattttttggcattttaagttttatataaatggatgcagatggagattatcacccacaaatatatttaaatggatttttcttaatttgaatttcaagtaatctttttatttcaagtaattagttacgcatttagttacattgccagttttttttttttatcaatttcagtaagacaaaatatactaaaatgtttaaatagcctcattcaatcttacattttgacatttcagcaatcattctggcttacagtaattagatcccctgttacgacacatgccctttgttcttaataactagcaaaaaaaaaaaaaaaaaaaaactttcatcttgttaaaatactttgccaaatgaaatagactagtcaatacatctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatatt

SEQ ID NO: 458888 - DNA, 6314 bp, Homo sapiens
  misc_feature (4034)..(4034): n is a, c, g, or t
cggctcccgggccccctcgctcctcccctctggcccctccgagcgctgggggtgcttccctccccgcctcctcgcactcccacctcgcgggcacgccggtgggctgtgccgccatgccccagccacaggctgctcacgggcctaggcgcggcggcccgagataggggcccctgagcctcccgggggaggagagaggcagcgagccgcgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaaggtaaacgctgtttccggtgccagatatgtagtgccactttcacttccttcggggaatataaacaccacatgagggtttcccggcacattatccgcaagcctcggatttacgagtgcaaaacatgtggcgccatgttcaccaactctggaaatttaatcgtgcacctgaggagtctgaaccatgaagcatcagagctagcaaactacttccagagcagtgatttcctagtaccggactacttaaaccaggaacaagaagagacccttgttcaatatgatcttggagaacacggttttgaaagcaactcctctgttcaaatgcctgtcatttcacaggtctcctcaacccagaattgtgaaagcacttttcccttggggtctcttggtgggctggcagaaaaagaggaagaagtgccagagcagccaaagagcagtgcttgtgctgaggcaaccagagatgaccccccaaaatcagagctgtcttctataactattgagtagttttgtgatttggcttcagttttgttttttggaaagtgcctgtgcttggtcttgtacatttaaatttaatttaattttttaaacaaaaaagccgggtgggagggagggggagattgggaaagaatttccctttttactttctgagccctgaaactgattttatttttcctaactgagagattgcttctgtaagtacacaataacatgatgttgaaacagaaactatgagacttaaggagaactggttgacttaaaacatataccagttccttcttccattgttaaaagtaggctaacaacagatcattagctagagaggaaatcagatgattattgaccttcttgagacaagagggtacatgagaaactaattactaaacagcttgacaaatggcctgagtagatacttactgctgtacacaggatgttgtataatattttgtaaagcctgttgtttttggaagtatttatggtaagctttcttaaaaattattatggtaaatacttctgaaatccggcgtacttttctttaagctttgtcatttctgttatgatttttcatggtgaaattttggtactgagatgggcattctctgtacctttatagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcccatatgacagcgatacattgtccttacatatttatttttagacattgcaaagttattaaaaacagttaactatagtttttacacaacgtaggcaacaatgaagagtatagactgtaagattttcatctatgactcataaatctgggagaaaaaaattattaagactaatgagaaactgaaaaccttaaactaatgaatattatttctgctgctaaaaatatgaaactttctggtctgtagttgaaatttgtatgatcctctagacttgggtatacttttcatctggtgccattaaagcatctctaatattgatcctaaatatttgtaagtccatgagcagtgaactttggaataagtttctgtgtagatacccaaagtttaataattatgagagcacctgatttgatagacagaaaatacagttctttagtcaaaacacaagatctgaattttgttcaggtgctagaccatactaaatgtatatatttttaattatagtgatttgtttcatntttttagattggctaattctgtaattttttccccaaaaacatgtgaagaaaggaaaagtaaattaaattccttagaactgttttaggttaagattctctgtgtctgcccatattctgcagtccttaacttgttttcaactctttacctcactcatgaacttgtttttacccatttgctgccaaacataggtgtgttcccttcaggagaatcagcatatacaggttatgataggctcccaccatttatgcttcttcactgatagggttgcattactttctgcagcagactataatacttcatatagtactgctgtgtctcaactggaaaggtcaggaattttaatgttacgttgtggtctttgaaaactgttaggcctagcaatagataaatctcaaaattaattttaaaatctgtattgacaagaataggtaaaattatgaccaggaatcattgttacccttagttccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcagaataaattgcctttttaaaaccaagcattttgtacaagcttttattttcagttttttaactaccaaataggtgtgatgtactttagaagtaaacaaagatgttcacccatgataatggatgttaaagctcctgcagttgttcttttcgtgtttaaagggtatattctaatagtggaagcatcaaacatgtcagtgatttcatctcattcagaaataaagagattaatattggtctttattttttggcattttaagttttatataaatggatgcagatggagattatcacccacaaatatatttaaatggatttttcttaatttgaatttcaagtaatctttttatttcaagtaattagttacgcatttagttacattgccagttttttttttttatcaatttcagtaagacaaaatatactaaaatgtttaaatagcctcattcaatcttacattttgacatttcagcaatcattctggcttacagtaattagatcccctgttacgacacatgccctttgttcttaataactagcaaaaaaaaaaaaaaaaaaaaactttcatcttgttaaaatactttgccaaatgaaatagactagtcaatacatctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatatt

SEQ ID NO: 458889 - DNA, 5325 bp, Homo sapiens
  misc_feature (3045)..(3045): n is a, c, g, or t
cggctcccgggccccctcgctcctcccctctggcccctccgagcgctgggggtgcttccctccccgcctcctcgcactcccacctcgcgggcacgccggtgggctgtgccgccatgccccagccacaggctgctcacgggcctaggcgcggcggcccgagataggggcccctgagcctcccgggggaggagagaggcagcgagccgcgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagtgatttcctagtaccggactacttaaaccaggaacaagaagagacccttgttcaatatgatcttggagaacacggttttgaaagcaactcctctgttcaaatgcctgtcatttcacagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcccatatgacagcgatacattgtccttacatatttatttttagacattgcaaagttattaaaaacagttaactatagtttttacacaacgtaggcaacaatgaagagtatagactgtaagattttcatctatgactcataaatctgggagaaaaaaattattaagactaatgagaaactgaaaaccttaaactaatgaatattatttctgctgctaaaaatatgaaactttctggtctgtagttgaaatttgtatgatcctctagacttgggtatacttttcatctggtgccattaaagcatctctaatattgatcctaaatatttgtaagtccatgagcagtgaactttggaataagtttctgtgtagatacccaaagtttaataattatgagagcacctgatttgatagacagaaaatacagttctttagtcaaaacacaagatctgaattttgttcaggtgctagaccatactaaatgtatatatttttaattatagtgatttgtttcatntttttagattggctaattctgtaattttttccccaaaaacatgtgaagaaaggaaaagtaaattaaattccttagaactgttttaggttaagattctctgtgtctgcccatattctgcagtccttaacttgttttcaactctttacctcactcatgaacttgtttttacccatttgctgccaaacataggtgtgttcccttcaggagaatcagcatatacaggttatgataggctcccaccatttatgcttcttcactgatagggttgcattactttctgcagcagactataatacttcatatagtactgctgtgtctcaactggaaaggtcaggaattttaatgttacgttgtggtctttgaaaactgttaggcctagcaatagataaatctcaaaattaattttaaaatctgtattgacaagaataggtaaaattatgaccaggaatcattgttacccttagttccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcagaataaattgcctttttaaaaccaagcattttgtacaagcttttattttcagttttttaactaccaaataggtgtgatgtactttagaagtaaacaaagatgttcacccatgataatggatgttaaagctcctgcagttgttcttttcgtgtttaaagggtatattctaatagtggaagcatcaaacatgtcagtgatttcatctcattcagaaataaagagattaatattggtctttattttttggcattttaagttttatataaatggatgcagatggagattatcacccacaaatatatttaaatggatttttcttaatttgaatttcaagtaatctttttatttcaagtaattagttacgcatttagttacattgccagttttttttttttatcaatttcagtaagacaaaatatactaaaatgtttaaatagcctcattcaatcttacattttgacatttcagcaatcattctggcttacagtaattagatcccctgttacgacacatgccctttgttcttaataactagcaaaaaaaaaaaaaaaaaaaaactttcatcttgttaaaatactttgccaaatgaaatagactagtcaatacatctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatatt

SEQ ID NO: 458890 - DNA, 5208 bp, Homo sapiens
  misc_feature (2927)..(2927): n is a, c, g, or t
cggctcccgggccccctcgctcctcccctctggcccctccgagcgctgggggtgcttccctccccgcctcctcgcactcccacctcgcgggcacgccggtgggctgtgccgccatgccccagccacaggctgctcacgggcctaggcgcggcggcccgagataggggcccctgagcctcccgggggaggagagaggcagcgagccgcgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcccatatgacagcgatacattgtccttacatatttatttttagacattgcaaagttattaaaaacagttaactatagtttttacacaacgtaggcaacaatgaagagtatagactgtaagattttcatctatgactcataaatctgggagaaaaaaattattaagactaatgagaaactgaaaaccttaaactaatgaatattatttctgctgctaaaaatatgaaactttctggtctgtagttgaaatttgtatgatcctctagacttgggtatacttttcatctggtgccattaaagcatctctaatattgatcctaaatatttgtaagtccatgagcagtgaactttggaataagtttctgtgtagatacccaaagtttaataattatgagagcacctgatttgatagacagaaaatacagttctttagtcaaaacacaagatctgaattttgttcaggtgctagaccatactaaatgtatatatttttaattatagtgatttgtttcatntttttagattggctaattctgtaattttttccccaaaaacatgtgaagaaaggaaaagtaaattaaattccttagaactgttttaggttaagattctctgtgtctgcccatattctgcagtccttaacttgttttcaactctttacctcactcatgaacttgtttttacccatttgctgccaaacataggtgtgttcccttcaggagaatcagcatatacaggttatgataggctcccaccatttatgcttcttcactgatagggttgcattactttctgcagcagactataatacttcatatagtactgctgtgtctcaactggaaaggtcaggaattttaatgttacgttgtggtctttgaaaactgttaggcctagcaatagataaatctcaaaattaattttaaaatctgtattgacaagaataggtaaaattatgaccaggaatcattgttacccttagttccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatccccccccccccccctccccccccccccatctcgccccctgttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcagaataaattgcctttttaaaaccaagcattttgtacaagcttttattttcagttttttaactaccaaataggtgtgatgtactttagaagtaaacaaagatgttcacccatgataatggatgttaaagctcctgcagttgttcttttcgtgtttaaagggtatattctaatagtggaagcatcaaacatgtcagtgatttcatctcattcagaaataaagagattaatattggtctttattttttggcattttaagttttatataaatggatgcagatggagattatcacccacaaatatatttaaatggatttttcttaatttgaatttcaagtaatctttttatttcaagtaattagttacgcatttagttacattgccagttttttttttttatcaatttcagtaagacaaaatatactaaaatgtttaaatagcctcattcaatcttacattttgacatttcagcaatcattctggcttacagtaattagatcccctgttacgacacatgccctttgttcttaataactagcaaaaaaaaaaaaaaaaaaaaactttcatcttgttaaaatactttgccaaatgaaatagactagtcaatacatctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatatt

SEQ ID NO: 458891 - DNA, 1563 bp, Homo sapiens
cggctcccgggccccctcgctcctcccctctggcccctccgagcgctgggggtgcttccctccccgcctcctcgcactcccacctcgcgggcacgccggtgggctgtgccgccatgccccagccacaggctgctcacgggcctaggcgcggcggcccgagataggggcccctgagcctcccgggggaggagagaggcagcgagccgcgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtacccccaagaacgtctgagccttcaatgttgaattttttctttattaaaattacttttatcttataaaat

SEQ ID NO: 458892 - DNA, 489 bp, Homo sapiens
gctaaagatgcatcgcctaaagcatgaaggtaaacgctgtttccggtgccagatatgtagtgccactttcacttccttcggggaatataaacaccacatgagggtttcccggcacattatccgcaagcctcggatttacgagtgcaaaacatgtggcgccatgttcaccaactctggaaatttaatcgtgcacctgaggagtctgaaccatgaagcatcagagctagcaaactacttccagagcaggtgaggtgcacaacgaaaacccaaccaggaaaactgctttctaaactctcttttcctgcttttagggcagccttctgtgtttttacatcaggttgccagctagtcagtcacatttgttacggattcccactgttcatactctaatctcctgatctgataaaattttgctgagtcttctacgtatataaaattataaacattttatagttggtattaaaaatattttcctgcagaagtagacta

SEQ ID NO: 458893 - DNA, 5207 bp, Homo sapiens
  misc_feature (2927)..(2927): n is a, c, g, or t
cggctcccgggccccctcgctcctcccctctggcccctccgagcgctgggggtgcttccctccccgcctcctcgcactcccacctcgcgggcacgccggtgggctgtgccgccatgccccagccacaggctgctcacgggcctaggcgcggcggcccgagataggggcccctgagcctcccgggggaggagagaggcagcgagccgcgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcccatatgacagcgatacattgtccttacatatttatttttagacattgcaaagttattaaaaacagttaactatagtttttacacaacgtaggcaacaatgaagagtatagactgtaagattttcatctatgactcataaatctgggagaaaaaaattattaagactaatgagaaactgaaaaccttaaactaatgaatattatttctgctgctaaaaatatgaaactttctggtctgtagttgaaatttgtatgatcctctagacttgggtatacttttcatctggtgccattaaagcatctctaatattgatcctaaatatttgtaagtccatgagcagtgaactttggaataagtttctgtgtagatacccaaagtttaataattatgagagcacctgatttgatagacagaaaatacagttctttagtcaaaacacaagatctgaattttgttcaggtgctagaccatactaaatgtatatatttttaattatagtgatttgtttcatntttttagattggctaattctgtaattttttccccaaaaacatgtgaagaaaggaaaagtaaattaaattccttagaactgttttaggttaagattctctgtgtctgcccatattctgcagtccttaacttgttttcaactctttacctcactcatgaacttgtttttacccatttgctgccaaacataggtgtgttcccttcaggagaatcagcatatacaggttatgataggctcccaccatttatgcttcttcactgatagggttgcattactttctgcagcagactataatacttcatatagtactgctgtgtctcaactggaaaggtcaggaattttaatgttacgttgtggtctttgaaaactgttaggcctagcaatagataaatctcaaaattaattttaaaatctgtattgacaagaataggtaaaattatgaccaggaatcattgttacccttagttccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcagaataaattgcctttttaaaaccaagcattttgtacaagcttttattttcagttttttaactaccaaataggtgtgatgtactttagaagtaaacaaagatgttcacccatgataatggatgttaaagctcctgcagttgttcttttcgtgtttaaagggtatattctaatagtggaagcatcaaacatgtcagtgatttcatctcattcagaaataaagagattaatattggtctttattttttggcattttaagttttatataaatggatgcagatggagattatcacccacaaatatatttaaatggatttttcttaatttgaatttcaagtaatctttttatttcaagtaattagttacgcatttagttacattgccagttttttttttttatcaatttcagtaagacaaaatatactaaaatgtttaaatagcctcattcaatcttacattttgacatttcagcaatcattctggcttacagtaattagatcccctgttacgacacatgccctttgttcttaataactagcaaaaaaaaaaaaaaaaaaaaactttcatcttgttaaaatactttgccaaatgaaatagactagtcaatacatctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatatt

SEQ ID NO: 458894 - DNA, 6046 bp, Homo sapiens
  misc_feature (3766)..(3766): n is a, c, g, or t
cggctcccgggccccctcgctcctcccctctggcccctccgagcgctgggggtgcttccctccccgcctcctcgcactcccacctcgcgggcacgccggtgggctgtgccgccatgccccagccacaggctgctcacgggcctaggcgcggcggcccgagataggggcccctgagcctcccgggggaggagagaggcagcgagccgcgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagtgatttcctagtaccggactacttaaaccaggaacaagaagagacccttgttcaatatgatcttggagaacacggttttgaaagcaactcctctgttcaaatgcctgtcatttcacaggtctcctcaacccagaattgtgaaagcacttttcccttggggtctcttggtgggctggcagaaaaagaggaagaagtgccagagcagccaaagagcagtgcttgtgctgaggcaaccagagatgaccccccaaaatcagagctgtcttctataactattgagtagttttgtgatttggcttcagttttgttttttggaaagtgcctgtgcttggtcttgtacatttaaatttaatttaattttttaaacaaaaaagccgggtgggagggagggggagattgggaaagaatttccctttttactttctgagccctgaaactgattttatttttcctaactgagagattgcttctgtaagtacacaataacatgatgttgaaacagaaactatgagacttaaggagaactggttgacttaaaacatataccagttccttcttccattgttaaaagtaggctaacaacagatcattagctagagaggaaatcagatgattattgaccttcttgagacaagagggtacatgagaaactaattactaaacagcttgacaaatggcctgagtagatacttactgctgtacacaggatgttgtataatattttgtaaagcctgttgtttttggaagtatttatggtaagctttcttaaaaattattatggtaaatacttctgaaatccggcgtacttttctttaagctttgtcatttctgttatgatttttcatggtgaaattttggtactgagatgggcattctctgtacctttatagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcccatatgacagcgatacattgtccttacatatttatttttagacattgcaaagttattaaaaacagttaactatagtttttacacaacgtaggcaacaatgaagagtatagactgtaagattttcatctatgactcataaatctgggagaaaaaaattattaagactaatgagaaactgaaaaccttaaactaatgaatattatttctgctgctaaaaatatgaaactttctggtctgtagttgaaatttgtatgatcctctagacttgggtatacttttcatctggtgccattaaagcatctctaatattgatcctaaatatttgtaagtccatgagcagtgaactttggaataagtttctgtgtagatacccaaagtttaataattatgagagcacctgatttgatagacagaaaatacagttctttagtcaaaacacaagatctgaattttgttcaggtgctagaccatactaaatgtatatatttttaattatagtgatttgtttcatntttttagattggctaattctgtaattttttccccaaaaacatgtgaagaaaggaaaagtaaattaaattccttagaactgttttaggttaagattctctgtgtctgcccatattctgcagtccttaacttgttttcaactctttacctcactcatgaacttgtttttacccatttgctgccaaacataggtgtgttcccttcaggagaatcagcatatacaggttatgataggctcccaccatttatgcttcttcactgatagggttgcattactttctgcagcagactataatacttcatatagtactgctgtgtctcaactggaaaggtcaggaattttaatgttacgttgtggtctttgaaaactgttaggcctagcaatagataaatctcaaaattaattttaaaatctgtattgacaagaataggtaaaattatgaccaggaatcattgttacccttagttccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcagaataaattgcctttttaaaaccaagcattttgtacaagcttttattttcagttttttaactaccaaataggtgtgatgtactttagaagtaaacaaagatgttcacccatgataatggatgttaaagctcctgcagttgttcttttcgtgtttaaagggtatattctaatagtggaagcatcaaacatgtcagtgatttcatctcattcagaaataaagagattaatattggtctttattttttggcattttaagttttatataaatggatgcagatggagattatcacccacaaatatatttaaatggatttttcttaatttgaatttcaagtaatctttttatttcaagtaattagttacgcatttagttacattgccagttttttttttttatcaatttcagtaagacaaaatatactaaaatgtttaaatagcctcattcaatcttacattttgacatttcagcaatcattctggcttacagtaattagatcccctgttacgacacatgccctttgttcttaataactagcaaaaaaaaaaaaaaaaaaaaactttcatcttgttaaaatactttgccaaatgaaatagactagtcaatacatctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatatt

SEQ ID NO: 458895 - DNA, 5432 bp, Homo sapiens
  misc_feature (3152)..(3152): n is a, c, g, or t
cggctcccgggccccctcgctcctcccctctggcccctccgagcgctgggggtgcttccctccccgcctcctcgcactcccacctcgcgggcacgccggtgggctgtgccgccatgccccagccacaggctgctcacgggcctaggcgcggcggcccgagataggggcccctgagcctcccgggggaggagagaggcagcgagccgcgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagggcatcccaggaaatcagcttctagatctagctctgccactaactgctgttgattaaacctgtcactttacacatgaaaaagcttgaaacttagagaaagataaaattgatttcctagtaccggactacttaaaccaggaacaagaagagacccttgttcaatatgatcttggagaacacggttttgaaagcaactcctctgttcaaatgcctgtcatttcacagtaccactccaaaggcaaggaaccatgattgacaacagtcaagctgtggatgaaatgaccaggaacggagaatgaagtatgtaaatcccagcttcataggaactcttctcatactgcttttcagattaaaattgctgtttacctggtctccgaatgtaatgcctgactgtgtcattgcccggatcagttttccccctgccccatcaatatgttctcttgcatatattggcgtgctgccatataaagtaaaaatactggagatattctatattttatatataggtttatgtgttgttggggatgttttcattgtgctcttttggacataataaataattctctattgaggctacattctttttttttttctttttttttaaaagaatggcatctcactctgttgcccaggctggagtatagtggctaagtcatagctcactgcagcttcgaactcctgggctcaggccattctcctgcctcagcctcttgagtatctaggattataggcatgctccaccacacctggttaacttcatttttattttttgtagagatgaggtctcactatggtgcccaggctggtcttgaactcctagaccaagtgatcctcctcctttggcctcccagactgctgggatcactgcaccggccaaggctgcattcttaacccaactagattgtttactgaatcccatatgacagcgatacattgtccttacatatttatttttagacattgcaaagttattaaaaacagttaactatagtttttacacaacgtaggcaacaatgaagagtatagactgtaagattttcatctatgactcataaatctgggagaaaaaaattattaagactaatgagaaactgaaaaccttaaactaatgaatattatttctgctgctaaaaatatgaaactttctggtctgtagttgaaatttgtatgatcctctagacttgggtatacttttcatctggtgccattaaagcatctctaatattgatcctaaatatttgtaagtccatgagcagtgaactttggaataagtttctgtgtagatacccaaagtttaataattatgagagcacctgatttgatagacagaaaatacagttctttagtcaaaacacaagatctgaattttgttcaggtgctagaccatactaaatgtatatatttttaattatagtgatttgtttcatntttttagattggctaattctgtaattttttccccaaaaacatgtgaagaaaggaaaagtaaattaaattccttagaactgttttaggttaagattctctgtgtctgcccatattctgcagtccttaacttgttttcaactctttacctcactcatgaacttgtttttacccatttgctgccaaacataggtgtgttcccttcaggagaatcagcatatacaggttatgataggctcccaccatttatgcttcttcactgatagggttgcattactttctgcagcagactataatacttcatatagtactgctgtgtctcaactggaaaggtcaggaattttaatgttacgttgtggtctttgaaaactgttaggcctagcaatagataaatctcaaaattaattttaaaatctgtattgacaagaataggtaaaattatgaccaggaatcattgttacccttagttccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcagaataaattgcctttttaaaaccaagcattttgtacaagcttttattttcagttttttaactaccaaataggtgtgatgtactttagaagtaaacaaagatgttcacccatgataatggatgttaaagctcctgcagttgttcttttcgtgtttaaagggtatattctaatagtggaagcatcaaacatgtcagtgatttcatctcattcagaaataaagagattaatattggtctttattttttggcattttaagttttatataaatggatgcagatggagattatcacccacaaatatatttaaatggatttttcttaatttgaatttcaagtaatctttttatttcaagtaattagttacgcatttagttacattgccagttttttttttttatcaatttcagtaagacaaaatatactaaaatgtttaaatagcctcattcaatcttacattttgacatttcagcaatcattctggcttacagtaattagatcccctgttacgacacatgccctttgttcttaataactagcaaaaaaaaaaaaaaaaaaaaactttcatcttgttaaaatactttgccaaatgaaatagactagtcaatacatctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatatt

SEQ ID NO: 458896 - DNA, 3733 bp, Homo sapiens
cggctcccgggccccctcgctcctcccctctggcccctccgagcgctgggggtgcttccctccccgcctcctcgcactcccacctcgcgggcacgccggtgggctgtgccgccatgccccagccacaggctgctcacgggcctaggcgcggcggcccgagataggggcccctgagcctcccgggggaggagagaggcagcgagccgcgcgctccgccccctccccccgggccgccgccgccgccgcctcgccgccccagcctggcgggagaaggaggaggagcagcaggcctccgggcccggcgccgccgcccgcaggacatttctgatttatttgcatccttgaagagcatctgtagaagaggaagtaaaagatgggtgtgaaaacatttactcatagctcctcttcccacagccaggaaatgcttggaaagctaaatatgctgcgaaatgatggacatttttgtgatatcactattcgtgtccaggacaaaatcttccgggcacataaggtggtactagcagcttgcagtgatttctttcgcaccaaacttgtaggccaagccgaggatgagaacaagaatgtgttggatctgcatcatgttacagtgactggctttatacctcttttagaatatgcttacacagccactctatcaattaacacagaaaatattattgatgttctagcagcagccagctatatgcaaatgttcagtgttgccagcacctgctcagagttcatgaaatcaagcattttatggaatacacccaacagccaacctgaaaagggtctagatgctggacaagaaaataattctaactgcaattttacttctcgagatgggagcatttctcccgtgtcctcagagtgcagtgtggtagaaagaaccattcctgtctgccgagaatcccggagaaagcgcaaaagctacattgttatgtctcctgaaagtcctgtaaagtgtggcacacaaacaagctcaccccaggtattgaattcttcagcttcctactcagaaaatagaaaccaaccagttgactcttccttagcttttccttggacttttccttttggaattgatcgaaggattcagcctgagaaagttaagcaagcagaaaatacccggactttagaattacctggcccatctgagaccggtagaagaatggctgattatgtgacttgtgagagcacaaaaactaccttgcctttaggtaccgaagaagatgtccgggtcaaagtagaaagattaagtgatgaggaggtccatgaggaagtgtcccagcctgtcagtgcatctcagagttcgctgagtgatcagcagacagttccaggaagtgaacaagtccaagaggaccttctgattagtccacagtcttcctctataggctcagtagatgaaggcgtttctgagggcttgcctacacttcaaagcacgtctagcactaatgctcctccggatgatgatgatcgattggaaaatgttcagtatccctaccaactctacattgctccttccaccagcagtacagagcgaccaagtccaaatggtcccgacagaccttttcagtgtccaacctgcggggtgcgattcacccgtattcagaacctaaagcagcacatgctcatccactcaggaattaaaccatttcagtgtgaccgctgtgggaaaaagttcaccagggcttactcgctaaagatgcatcgcctaaagcatgaagtgatttcctagtaccggactacttaaaccaggaacaagaagagacccttgttcaatatgatcttggagaacacggttttgaaagcaactcctctgttcaaatgcctgtcatttcacagtaccactccaaaggcaaggaaccatgattgacaacagtcaagctgtggatgaaatgaccaggaacggagaatgaattccaagaggtggtttttgaaagagcaagaggaaagaaaaaagaaaagaaggaaagaagaataaagaagagaaacgtgtaagaatggtttgcagattgattggttaaaagtgtttttagcacatccccaaccctgaaaacttcgcattaagagccaagcacaatgttggtagctccaagatattctgactgtgttctcagaatgagggattacccatcactgggtattccttcccaagtagaaactttagattttcactggtaatacacattgccaagttttatgggaaatctgaatatactgtgaaaatgcatatctggttagttgtctgctgcccagatcttatcaataccagtaactaaccagtatttaacataaaatgatacaaataaaggcctttttctatttcagtgagggtacatttttcttgatatatatgtactttaaggatattggatctgtttatggatctgttttaggaaacagatttgcaagggataattgtatatatagtagtatttaggtttatttcaaattcatcttagggatgcctagatgcataatttttaccaggacatattgaaaatattgcaaagagatagccagttatattatcccattcattagaaattaccagtgtaactaaacataaatattccagtttagagtgcttaaacgtagctatctttcttaaggccaggagggtaactttgtggtatctaaagggcttaaatttcagaatgcagaataaattgcctttttaaaaccaagcattttgtacaagcttttattttcagttttttaactaccaaataggtgtgatgtactttagaagtaaacaaagatgttcacccatgataatggatgttaaagctcctgcagttgttcttttcgtgtttaaagggtatattctaatagtggaagcatcaaacatgtcagtgatttcatctcattcagaaataaagagattaatattggtctttattttttggcattttaagttttatataaatggatgcagatggagattatcacccacaaatatatttaaatggatttttcttaatttgaatttcaagtaatctttttatttcaagtaattagttacgcatttagttacattgccagttttttttttttatcaatttcagtaagacaaaatatactaaaatgtttaaatagcctcattcaatcttacattttgacatttcagcaatcattctggcttacagtaattagatcccctgttacgacacatgccctttgttcttaataactagcaaaaaaaaaaaaaaaaaaaaactttcatcttgttaaaatactttgccaaatgaaatagactagtcaatacatctgatgtccataattattggtaactcagttaccttctaactaataggctggttcaggagactctcccagtttataaatggttctcttgggagcctttggaagctgtattaaatctttcagtcttttatttctaattttttctcttaatctaaatagaggccagttatctattttatcagcttttattcttgaagattctcagattatgttttagtcccttttagctttaatagtccttgaaaaatacattactgtataatgtggcaattctgtaacagagacttattacttgaatgaataatcctaaaattttaatattttagctgaagtttgagatttgtggaatgaacaaaagaattagaaactttcatatgttactttgtttcagtcatctgcaaagtatgaagctgtaattctgaaatacacatccaagtgaatgagaattaaaaattttctaaatatt

SEQ ID NO: 458897 - DNA, 448 bp, Homo sapiens
agatgtttcaacattaccagtttaaattcttaagaatccatataaatggtttattataattccaaaagtgagtgactttacaattttacaggggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttcacctgaactgaacaccattgaaggcttaaacccatattgtaaaacaggtagaattatctaatttatacaaaggtgttttgatgacctttggtgtggttcatctt

SEQ ID NO: 458898 - DNA, 469 bp, Homo sapiens
  misc_feature (7)..(7): n is a, c, g, or t
cggtacncagcctttccggcgggtaaggactctccctcccttgtatatcagaaaacaattgttcatttcagacaagaacctcactgcatttaacccaatatcattagcattttaatttggagacttgtctaagcatcatttcatttatgtaatgtcttccatggtagatgaagaagataaggatagtttacaggaactctctacagaacagaaatgctttgttgaacacatcctttgtacgaagccattgccctgcaggtaaggactctccctcccttgtatatcagaaaacaattgttcatttcagcagttcagatacgtttgtatccgttacactcacatccacagtattcactgctgagtcatttgaaagttgcagacgtgatacttctcccctaagagtgtcctgctcatcagaagctttctcctctccagggccactcgacatactgtttcctgactggaaggt

SEQ ID NO: 458899 - DNA, 5254 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagcttaagatccacaattgcaaaggccactgctggctcacttcctcacaggctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtagtactatatctgcttagaaatggctgagtgactgccaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataatcatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccactgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatcc

SEQ ID NO: 458900 - DNA, 5302 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagcttaagatccacaattgcaaaggccactgctggctcacttcctcacaggctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtagtactatatctgcttagaaatggctgagtgactgccaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataatcatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccactgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatcc

SEQ ID NO: 458901 - DNA, 5333 bp, Homo sapiens
ggaggaggggtgcacacgctagtacaagctggttaaaatcggcgagggcgcgcgagtgagggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagcttaagatccacaattgcaaaggccactgctggctcacttcctcacaggctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtagtactatatctgcttagaaatggctgagtgactgccaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataatcatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccactgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatcc

SEQ ID NO: 458902 - DNA, 3644 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagcttaagatccacaattgcaaaggccactgctggctcacttcctcacaggctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtagtactatatctgcttagaaatggctgagtgactgccaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtgtaagcaggaagtgatttcaatcctttgctttttatcatgcatccgttccccggtaact

SEQ ID NO: 458903 - DNA, 5291 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagcttaagatccacaattgcaaaggccactgctggctcacttcctcacaggctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtagtactatatctgcttagaaatggctgagtgactgccaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataatcatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccactgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatcc

SEQ ID NO: 458904 - DNA, 2652 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttaaaaataaataatatccccttacttacactttctttattccccttcccatatacttcttctcctctccactacccccctcctttattctctatttcccttatttttccttccaccactatacccgatatttctttctctctccctacttcaaactcatatatcggctccttcttcccacatttttttcct

SEQ ID NO: 458905 - DNA, 4166 bp, Homo sapiens
aacttttgagattacagtcagcagcacgctacagttagggattcctgagtgacttagtcacatgggctctagactttagtgtggagctgcattaaaggtttccaagccaccacttttgaggttatggtactgataggatgtcccaagcaacttcagcccaggcctgagaaggccgcggacctgtcatgtctttgctcttggttccattgcatttgctgctttgtaatttaactatgactgtgtttttccaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagcttaagatccacaattgcaaaggccactgctggctcacttcctcacaggctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtagtactatatctgcttagaaatggctgagtgactgccaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataatcatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccactgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatcc

SEQ ID NO: 458906 - DNA, 3292 bp, Homo sapiens
  misc_feature (2540)..(2540): n is a, c, g, or t
  misc_feature (2551)..(2551): n is a, c, g, or t
  misc_feature (2634)..(2634): n is a, c, g, or t
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggacatcaacagcagaccggcaattgcgcttttgatctaaaggaaagatgaaagcctggatcctgcaatacactgagattatagaaaactgcaaagcaaaccaaatccaggttgctctaacttaaattccgcaatgctagtcaggcagattgctccaacctgagagctgtgagttcaggtggggaggttcacattccactgtgattaactagctagctcctttctctgtcacaattacctggaatacccaaggcagactatgacaagggtcaggtgacacacgttaatatccattgctggcaacatgtgcctgcactgactccaggaaccgtctgttgaatgaacgctaaatcccagagcttcccagtgtgccncagcgtgagangaggaaaaacgtgagaaaggtaactcacctctttctgcaagagattccattctgtttcactaactaaacgataaccactaggngacacataggcactctccatgccctgggtaacgctggagaggagggacgctgtctcttcttgttctggtgtcatcgccttgattgctctttcctgatctttggttaacataaacccacttggcatctggagtgacccaagggatgcagtatcaaagttctcagacactgaatctgctcctaccagtggtccaaaatctgactcgtccaggtttccagcagattttgctttgtagttatagcctaaagctttggattgcaatgagcccgaggttcccaagctgtctgtagactgtgctctcctgagtccatctttaaacatgtcattgtccgatttactgaaaggatctccagatggcaacagcaagcctgcatctaaggaatgaactgagccacgggtgctgtctaaatgctcctgaaatgtgaaaatacatatggccaagttagacaattctctgcgtttttaaagacaaaaactataataaatgtattccgccactcattacacatgataatcattaatgtgctaccttcacagactcattgaacaaacactaagtgtcatttctacatgctggacacaaaaccaggccctcaggatacaactgtgagcaagatataatccctgacctcgagatacatacggcttcaaaaaaaaaa

SEQ ID NO: 458907 - DNA, 2447 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaattgttttactcagctaaggaaaataaaggtagaaactttgtttttagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggatgagtgactttacaattttacaggggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatga

SEQ ID NO: 458908 - DNA, 2224 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaagtatgcaaccttgggcatagcggttttatgaatgggttctcttctgtcttcagaattactgtgcatcctttctgtcctcatctgtttcatatactttttactgtgataaatttggaagaaactggatatatttgatcagctagtgaatggggagcaggagggaagtggcacctgagaatgataaacaggaagtgtttaaaaagaagttaggctaggccgggcgtggtggctcacacctgtaatctcagcactttgggagaccaagacgggtgaatcgcgaggtcaggagatcgagaccatcctggctaacacagcaaaaccccatctctataaaaatgcaataattagccaggcgtggtggtgggcacctgtaatcccagctactcgagaggctgaggcagaagaattgctcgaacctgggaggtggaggttgcagtgagccgagatagcaccaatgcactccagcctgggtgacagagcgagactgcatctcaaataaataaattaaaaatataaaaagtttaaaaagcacc

SEQ ID NO: 458909 - DNA, 1617 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattgtacgtcccattttatattctccacacagctcttgttaattctgcaatatctaagttgggaaaatgcactcagtaaccaacttga

SEQ ID NO: 458910 - DNA, 3226 bp, Homo sapiens
agatgtttcaacattaccagtttaaattcttaagaatccatataaatggtttattataattccaaaagtgagtgactttacaattttacaggggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagcttaagatccacaattgcaaaggccactgctggctcacttcctcacaggctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtagtactatatctgcttagaaatggctgagtgactgccaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataatcatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccactgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatcc

SEQ ID NO: 458911 - DNA, 1262 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagaggtaagctcttcaataaatgtag

SEQ ID NO: 458912 - DNA, 2261 bp, Homo sapiens
  misc_feature (18)..(18): n is a, c, g, or t
ggaccacttcagagtgcncttccggagtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataatcatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccactgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatcc

SEQ ID NO: 458913 - DNA, 684 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccaggtaatgccaggccgatcttggaagtgaccctcaccgggatcggaaccagtcttttttgttccttgctcctcttggctgtttttcatcttgtggcaggcgttccagcggattgactccgacgctgccatacgcggtcgcggggactcaggctctctcgatgcttacggcctggaggcctgggaggaaggaaagggtcattgaatattcaataaaaatactagtgacggatgagtgctctggagaaaaacaaagcgggctaaaggggttgagaacgagtgggcggagttgctatttttagtttcgtcgagagaaacctgtttcctgatgtgacgcttataa

SEQ ID NO: 458914 - DNA, 604 bp, Homo sapiens
aataaataaattaaaaatataaaaagtttaaaaagcacctgtgacttgagtctatttattttcagttgttttactcagctaaggaaaataaaggtagaaactttgtttttagcttctgaaaaggacatagcccctcctcctgaagaatgccttcagctcctcagcagagccacccaggtgttcagagagcagtacattctcaaacaggacttggcaaaggaggagattcagcggaggtatgatgtcctgtgttcacaaaccatcgatccctggctggtagctgatgctgtatggtagcctagacctggcttctgaataaactctatttctttttgtttttaaagggtcaaattattatgtgaccaaaaaaagaaacaactagaagatctcagttattgtcgagaagagaggtaagtgtcaaaaataagaagaatacaataggtcagtaagactggaaccatattctcaccctaagatgctgagccacattaggtggtttcagcatcaaggggtggacctcaagagtctcttgtgtcttacatcattaggaaaagtctgcgggaaatggctgagcgtttagctgacaaatatgaggaagctaaag

SEQ ID NO: 458915 - DNA, 405 bp, Homo sapiens
ttagctgacaaatatgaggaagctaaagaaaaacaagaggatatcatgaacaggtcagtgggctgtataacatttagttacctagtcaggtactaacaacgatatttaagaaaatgggcattggcaggtgcttacatacctacggaactgaactgatccccctgcctctcctctgaagtatatgttggggaaaacatgaggctctcccctaacccttcctatggggcctacttcagaaacaccagattcatgaattatgagcttgtgattatgtttctcctaattagtagagaccttaaattgagatgtttgcttgccttttctaaaggatgaaaaaactacttcacagttttcactctgagctcccagttctctctgatagtgagcgagacatgaagaaagaat

SEQ ID NO: 458916 - DNA, 383 bp, Homo sapiens
aaatgtgtggcaaaccactgccaaaatatctattattttaatacttaaggttactatgaaaaaggattatcaacagcaaaagatggagaaggtgttgagtcttccaaaacccaccattattctcagtgcctaccagcgaaagtgcattcagtccatcctgaaagaggagtaagtaaatacttccaatcagctattatcgtgagatagtttttcctttacagtatgccagaatcaacctgtcttaatagaaacctgaatcttggtatttgcatgtcaagtaattactgggatgagagccacatgatacatagggacttaagaaatgactatggtgggaggattgaaagggatgaccttctagtaacatgattttgttgtgtggc

SEQ ID NO: 458917 - DNA, 815 bp, Homo sapiens
gtctcccctccgtgttctggctgaaaccccagattcctttgaaaagcatattagaagcattttgcaacgtagtgttgccaatccagcatttttgaagtatgcaaccttgggcatagcggttttatgaatgggttctcttctgtcttcagaattactgtgcatcctttctgtcctcatctgtttcatatactttttactgtgataaatttggaagaaactggatatatttgatcagctagtgaatggggagcaggagggaagtggcacctgagaatgataaacaggaagtgtttaaaaagaagttaggctaggccgggcgtggtggctcacacctgtaatctcagcactttgggagaccaagacgggtgaatcgcgaggtcaggagatcgagaccatcctggctaacacagcaaaaccccatctctactaaaaatacaaaaaaaaattagctgggtgtggtggcagatgcctgtaatcccagctacttgggaggctgaggcaggagaaccgcttgaacctgggaggcagaggttgcagtgagctgagatcccaccactgcactccagcctgggcgacagtgagactcgtctcaagttaggctgggcacggtggcttacagctgtaatcccagcactttgggaggcccaggcaggcggatcacctaaggtcaggagttcaaaaccagcccggccaacatggtgaaaccctgtctctactaaaaatgcaataattagccaggcgtggtggtgggcacctgtaatcccagctactcgagaggctgaggcagaagaattgctcgaacctgggaggtggag

SEQ ID NO: 458918 - DNA, 452 bp, Homo sapiens
tgtttttgtttttaacaagttggtttttacatctctttccagaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacaggtaagttgaggtggtcacccacctgaaatgaaaactcagtttgggctccagtagatatcattgaggctggacttgggagccatgtttttgagtctgtggaaatgttgcagccttcacatgcttggcttgcatatttttgagaaagagttagtacaggtcatttggcctttcatttcttcatattatttgggtaagttctatagaattcttggataatcacttatgataggcct

SEQ ID NO: 458919 - DNA, 2379 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatga

SEQ ID NO: 458920 - DNA, 5345 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagcttaagatccacaattgcaaaggccactgctggctcacttcctcacaggctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtagtactatatctgcttagaaatggctgagtgactgccaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataatcatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccactgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatcc

SEQ ID NO: 458921 - DNA, 5246 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagcttaagatccacaattgcaaaggccactgctggctcacttcctcacaggctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtagtactatatctgcttagaaatggctgagtgactgccaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataatcatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccactgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatcc

SEQ ID NO: 458922 - DNA, 5291 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagcttaagatccacaattgcaaaggccactgctggctcacttcctcacaggctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtagtactatatctgcttagaaatggctgagtgactgccaattaaaagccacatgataaggtaggttacaggtaagaggtaaatcaggttagacatgcatgagaacatttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataatcatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccactgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatcc

SEQ ID NO: 458923 - DNA, 5472 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagatggagtttcgctcttgttgcccaggctggagtgcaatggcgccatctcggctcaccgcaacctccaccttccagtttcaagcgattcttctgcctcagcccccccggcgagtagctgggattacagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagcttaagatccacaattgcaaaggccactgctggctcacttcctcacaggctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtagtactatatctgcttagaaatggctgagtgactgccaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataatcatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccactgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatcc

SEQ ID NO: 458924 - DNA, 3465 bp, Homo sapiens
  misc_feature (2713)..(2713): n is a, c, g, or t
  misc_feature (2724)..(2724): n is a, c, g, or t
  misc_feature (2807)..(2807): n is a, c, g, or t
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacagcatcaacagcagaccggcaattgcgcttttgatctaaaggaaagatgaaagcctggatcctgcaatacactgagattatagaaaactgcaaagcaaaccaaatccaggttgctctaacttaaattccgcaatgctagtcaggcagattgctccaacctgagagctgtgagttcaggtggggaggttcacattccactgtgattaactagctagctcctttctctgtcacaattacctggaatacccaaggcagactatgacaagggtcaggtgacacacgttaatatccattgctggcaacatgtgcctgcactgactccaggaaccgtctgttgaatgaacgctaaatcccagagcttcccagtgtgccncagcgtgagangaggaaaaacgtgagaaaggtaactcacctctttctgcaagagattccattctgtttcactaactaaacgataaccactaggngacacataggcactctccatgccctgggtaacgctggagaggagggacgctgtctcttcttgttctggtgtcatcgccttgattgctctttcctgatctttggttaacataaacccacttggcatctggagtgacccaagggatgcagtatcaaagttctcagacactgaatctgctcctaccagtggtccaaaatctgactcgtccaggtttccagcagattttgctttgtagttatagcctaaagctttggattgcaatgagcccgaggttcccaagctgtctgtagactgtgctctcctgagtccatctttaaacatgtcattgtccgatttactgaaaggatctccagatggcaacagcaagcctgcatctaaggaatgaactgagccacgggtgctgtctaaatgctcctgaaatgtgaaaatacatatggccaagttagacaattctctgcgtttttaaagacaaaaactataataaatgtattccgccactcattacacatgataatcattaatgtgctaccttcacagactcattgaacaaacactaagtgtcatttctacatgctggacacaaaaccaggccctcaggatacaactgtgagcaagatataatccctgacctcgagatacatacggcttcaaaaaaaaaa

SEQ ID NO: 458925 - DNA, 2232 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatcccaagtgtccttcaagatatcactgtactcatgaagctggtgtacatagtgttgggctaacttggattcataaacttcacaaatttcttggatcagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagtaagtaaatacttccaatcag

SEQ ID NO: 458926 - DNA, 3819 bp, Homo sapiens
accatcttctcgagtacaaagcaggggaggagacgctggatggactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagcttaagatccacaattgcaaaggccactgctggctcacttcctcacaggctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtagtactatatctgcttagaaatggctgagtgactgccaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataatcatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccactgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatcc

SEQ ID NO: 458927 - DNA, 4211 bp, Homo sapiens
aacttttgagattacagtcagcagcacgctacagttagggattcctgagtgacttagtcacatgggctctagactttagtgtggagctgcattaaaggtttccaagccaccacttttgaggttatggtactgataggatgtcccaagcaacttcagcccaggcctgagaaggccgcggacctgtcatgtctttgctcttggttccattgcatttgctgctttgtaatttaactatgactgtgtttttccaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaattgttttactcagctaaggaaaataaaggtagaaactttgtttttagcttctgaaaaggacatagcccctcctcctgaagaatgccttcagctcctcagcagagccacccaggtgttcagagagcagtacattctcaaacaggacttggcaaaggaggagattcagcggagggtcaaattattatgtgaccaaaaaaagaaacaactagaagatctcagttattgtcgagaagagaggaaaagtctgcgggaaatggctgagcgtttagctgacaaatatgaggaagctaaagaaaaacaagaggatatcatgaacaggatgaaaaaactacttcacagttttcactctgagctcccagttctctctgatagtgagcgagacatgaagaaagaattacagctgatacctgatcaacttcgacatttgggcaatgccatcaaacaggttactatgaaaaaggattatcaacagcaaaagatggagaaggtgttgagtcttccaaaacccaccattattctcagtgcctaccagcgaaagtgcattcagtccatcctgaaagaggagggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagcttaagatccacaattgcaaaggccactgctggctcacttcctcacaggctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtagtactatatctgcttagaaatggctgagtgactgccaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataatcatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagcctaatgatccaagttgaaaaattagcctatttaaaaacgtatactaatgtttttcactgatccaataactagactaaaacacttcaaaagagtagatggtaccagttcggctttatcctggtaccctgtgggcccatgaagatcatctaagtatgcagaaaaagtgcttccaaagtttcttgtgcttttcctttaaccttcaacttccagtatatatagccccagccaagttttcagatcctcatcattaattcacttcatgaattggttttgtttgccacagtcctatggttctcaggtaagtttcagtagcatttaaggtcctccaaagcaagataagataaaatggtaaaaggaaaacaaaatacagtcagtagccaatggcctgctctcaaaccttcatattttaatataaaatattcatacagcatactacacttctgtctgctaactgaatactgttactgatgagctctagacaacagataaagcaaattctctcttccaatatctatgaacagaaaattccaaacactactgggatgtcgctttagggtagggaaatgtgttccgaaaatctgtcttggagaaagcaggcaaggaaacagcgctttttccatcaccaaatctgatcccacgcctgttggaatcaagcctggagtttatagtgttcgcatttgaaggtctctgggctgcagatcaccccactgtttgctgtttcctgtgccgcacagtcttctccctctagaagtaagcatttctccagtcttccttttgttgtgacttctctttcttcagttaagagttaaataataattactgttgctctaaagatgagttaaaaacccaaagtgcaggctagaatcctgccatgagggtgtcatgtctcaggaagctggttaatgtctgtcagtttagtatcattcagaattgcccggattctctccaaggagtcagcttgccggatcc

SEQ ID NO: 458928 - DNA, 1672 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagagatgaagaagataaggatagtttacaggaactctctacagaacagaaatgctttgttgaacacatcctttgtacgaagccattgccctgcaggcagccagctccaattcgaggattttggattgtacctgacattctgggacccacgatgatctgcatcaccagtacctatgaatgcctcatatggccgttattaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaaagcttctgaaaaggacatagcccctcctcttgaagacactcgagtgttcttacaagatgtcactaggcgacgagaaatta

SEQ ID NO: 458929 - DNA, 1725 bp, Homo sapiens
gataaacccacaagacacaaaacatacctttcgagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtagtaccactccagttgcggagagatttttcaccagttccacctctctgactctaaagcatgctgcatggtatccaagtgaaatcctggatccccacgtagtgctgttaacatcagacaacgtaatcagaatttactcactacgtgagccgcagacacccactaacgtgataatactttcagaagccgaagaggaaagtctagtactcaataaaggaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacgaatgaaacccccacacacacacacatgcatacacacacacacacagcacacacacagaaaatatactgtaaagaaagagagaaaataaaaagttaaaaagttaaaaaaaaaaaaaaacctgtggtgcacctccagggggaggcaccacccaagagaacctccaccaatggtggaagagtttctctctctggactgggccacccatcggcgtgggttgtgggccccattttatccaccatataaaacgagtaacgcagctggctaaaaccaagaaaatttacaacggcggtacttacctttttgtcgaccgttgtgtccctactgtgattaacacatatttaacggaccgtggcggtggtgtaatttcccctatattaaccccaagaaccttgtggtaccacgtttaaacgcctattattctactacaacagctgtgtgtgggccaagctgcgtccacggacttaataacatgtcgcgcgggaattatattacaaacgggtcctttctcatgggtgggacccaacctttgggccttttcggccccaaaaagagattttctagaacggtaaacaaaatacttcagcgttccccattgggttcccaatttcaaccttaccatggagaacaacagca

SEQ ID NO: 458930 - DNA, 4836 bp, Homo sapiens
cagcctggtcagtgagtcactgcaacagcgagtgcatggcatggcactgtcagaactgggcacattcttgaggagcttcagtgatgctctgatccgattctcccgagaccacttcagggggaaatcaatggcccctcattacgtgccctacctactggccgccctcaaccacaagtcagcactcagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaaccggactggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttggtgagagcttcttgggcgggcagacgggcgagagtctcagtggctgggtgggagagaggtgctggcgcgagaccctaccccgacgtgctcagggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccggacgcctgagtctgtgtgtgttggggaaggtgggatggaataaaagtgcccacgagggttgagggaattcttgcagagtgacacgcttaaagtatcctggctcccgtcctggtacacgggctgcgccccgcctatgcaggcatctgccctctgtgcagactgcgttcccgaggccgcgggctacgcccccacgtctccgcgcccaggccgtgagcaagagtctccgccgccctggccgcctggagcccctgaagcccagcaactcgctgtggccttgggaagggggcgggcccaggaccacgaacaccgccccctcaaccctgcctggcttcgctcccagtggcctcgggggcgcgccgccgcggagactgacgcgaagccccacgctttcgtaagagcgtgcgcgcgcccgaggacgtacgtcatcggcgacggctcccgccggctgggcgtccggtggccggtgtagcagagcggggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgacaataaag

SEQ ID NO: 458931 - DNA, 3386 bp, Homo sapiens
ttttttttttttttttgagatggagtttcgctgttgttgcccaggctggagtgccatggcacaatcttggctcaccgcaaactccgcctcccgggttcaagcgattctcctacctcagcctcccgagtagctggggttacaggcatgtgccaccacgcccagctaattttgtattttagtagagacggggtttctccatgttggtcaggctggtctcgaactcccgacctcaggtgatccgcccgcctcggcctcccaaagtgctgggattacaggcgtgagccaccctgcctggcctccaggaggtagtgattaactgtatcgggtgctgatcaatatgaaggtcattgctggtcattggtgaccttgatcagatcaatttggatggagtgctgggaacaaaaggctaattggagtgaatttaagagagaacaggaaaaaaggaactggagactgggtatagatgactcgaggtatgtgctgcaataggagcaagtggagggagatgcagcggggctgtagctggaggagtgtgggttctagtgagggttttgttttgttttttaagatggagaagtaacagcatgtgtttatcctgatggaaagagtccagtagagaggaagagattgatgatgtaggagagaggagaaatgctggaagtgagtcactgagcaggcaagggagctcagcagctggagcctctccagaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgacaataaag

SEQ ID NO: 458932 - DNA, 2677 bp, Homo sapiens
cactatggctaggtctgaggcgagtttgtaattggtggaggataggctctcgtcagacacgctgactcggtccccgcatccgtgcgcccagttgctgaaactgtcagagcgaggtgggcgaccagggtacgccaggtcgcgattccgctggtgcttcgccctcttggctctgggggctccccccaatgcgtgcagggcctgggcgtgagtgagtaggccgttctggagcaggatgctcgcttggtccgatgccgtgagtcgtgcgtcagggtgcagatacctcctacgtctggttaaaatagtaacttgggccggtcggttttaagaagagactgctgtgatctgtctaccacttgtgaagcgtcgtatcggagatccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgacaataaag

SEQ ID NO: 458933 - DNA, 4668 bp, Homo sapiens
ccttcctcttgggtggtatgttctttttggtgggggcaaggaaaacaagtgatgattttttactccctcctcactgggatacttcccttcctttacgaatgaggaaacagaaaccgaaagaatgttttcctcaaggacgcaccgcgaatttgaggcaggtctcgctgggctgtgtcctttgcagctcgccaagcgcccgtctcccagccctggtccatgcctgggaccagaagtgcagagagccgctgttctcgctccctcccgtcaaacacttgccccacaaggtggcgccggagggtctggaccaccgagggccatgcgggccttggccttggtcctgaagccgtagttttgcttggtccagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaaccggactggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttggtgagagcttcttgggcgggcagacgggcgagagtctcagtggctgggtgggagagaggtgctggcgcgagaccctaccccgacgtgctcagggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccggacgcctgagtctgtgtgtgttggggaaggtgggatggaataaaagtgcccacgagggttgagggaattcttgcagagtgacacgcttaaagtatcctggctcccgtcctggtacacgggctgcgccccgcctatgcaggcatctgccctctgtgcagactgcgttcccgaggccgcgggctacgcccccacgtctccgcgcccaggccgtgagcaagagtctccgccgccctggccgcctggagcccctgaagcccagcaactcgctgtggccttgggaagggggcgggcccaggaccacgaacaccgccccctcaaccctgcctggcttcgctcccagtggcctcgggggcgcgccgccgcggagactgacgcgaagccccacgctttcgtaagagcgtgcgcgcgcccgaggacgtacgtcatcggcgacggctcccgccggctgggcgtccggtggccggtgtagcagagcggggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgacaataaag

SEQ ID NO: 458934 - DNA, 4579 bp, Homo sapiens
ccttcctcttgggtggtatgttctttttggtgggggcaaggaaaacaagtgatgattttttactccctcctcactgggatacttcccttcctttacgaatgaggaaacagaaaccgaaagaatgttttcctcaaggacgcaccgcgaatttgaggcaggtctcgctgggctgtgtcctttgcagctcgccaagcgcccgtctcccagccctggtccatgcctgggaccagaagtgcagagagccgctgttctcgctccctcccgtcaaacacttgccccacaaggtggcgccggagggtctggaccaccgagggccatgcgggccttggccttggtcctgaagccgtagttttgcttggtccagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaaccggactggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttggtgagagcttcttgggcgggcagacgggcgagagtctcagtggctgggtgggagagaggtgctggcgcgagaccctaccccgacgtgctcagggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccggacgcctgagtctgtgtgtgttggggaaggtgggatggaataaaagtgcccacgagggttgagggaattcttgcagagtgacacgcttaaagtatcctggctcccgtcctggtacacgggctgcgccccgcctatgcaggcatctgccctctgtgcagactgcgttcccgaggccgcgggctacgcccccacgtctccgcgcccaggccgtgagcaagagtctccgccgccctggccgcctggagcccctgaagcccagcaactcgctgtggccttgggaagggggcgggcccaggaccacgaacaccgccccctcaaccctgcctggcttcgctcccagtggcctcgggggcgcgccgccgcggagactgacgcgaagccccacgctttcgtaagagcgtgcgcgcgcccgaggacgtacgtcatcggcgacggctcccgccggctgggcgtccggtggccggtgtagcagagcggggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgacaataaag

SEQ ID NO: 458935 - DNA, 2489 bp, Homo sapiens
ccttcctcttgggtggtatgttctttttggtgggggcaaggaaaacaagtgatgattttttactccctcctcactgggatacttcccttcctttacgaatgaggaaacagaaaccgaaagaatgttttcctcaaggacgcaccgcgaatttgaggcaggtctcgctgggctgtgtcctttgcagctcgccaagcgcccgtctcccagccctggtccatgcctgggaccagaagtgcagagagccgctgttctcgctccctcccgtcaaacacttgccccacaaggtggcgccggagggtctggaccaccgagggccatgcgggccttggccttggtcctgaagccgtagttttgcttggtccagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaaccggactggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttggtgagagcttcttgggcgggcagacgggcgagagtctcagtggctgggtgggagagaggtgctggcgcgagaccctaccccgacgtgctcagggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccggacgcctgagtctgtgtgtgttggggaaggtgggatggaataaaagtgcccacgagggttgagggaattcttgcagagtgacacgcttaaagtatcctggctcccgtcctggtacacgggctgcgccccgcctatgcaggcatctgccctctgtgcagactgcgttcccgaggccgcgggctacgcccccacgtctccgcgcccaggccgtgagcaagagtctccgccgccctggccgcctggagcccctgaagcccagcaactcgctgtggccttgggaagggggcgggcccaggaccacgaacaccgccccctcaaccctgcctggcttcgctcccagtggcctcgggggcgcgccgccgcggagactgacgcgaagccccacgctttcgtaagagcgtgcgcgcgcccgaggacgtacgtcatcggcgacggctcccgccggctgggcgtccggtggccggtgtagcagagcggggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccagtgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgacaataaag

SEQ ID NO: 458936 - DNA, 2312 bp, Homo sapiens
ccttcctcttgggtggtatgttctttttggtgggggcaaggaaaacaagtgatgattttttactccctcctcactgggatacttcccttcctttacgaatgaggaaacagaaaccgaaagaatgttttcctcaaggacgcaccgcgaatttgaggcaggtctcgctgggctgtgtcctttgcagctcgccaagcgcccgtctcccagccctggtccatgcctgggaccagaagtgcagagagccgctgttctcgctccctcccgtcaaacacttgccccacaaggtggcgccggagggtctggaccaccgagggccatgcgggccttggccttggtcctgaagccgtagttttgcttggtccagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaaccggactggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttggtgagagcttcttgggcgggcagacgggcgagagtctcagtggctgggtgggagagaggtgctggcgcgagaccctaccccgacgtgctcagggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccggacgcctgagtctgtgtgtgttggggaaggtgggatggaataaaagtgcccacgagggttgagggaattcttgcagagtgacacgcttaaagtatcctggctcccgtcctggtacacgggctgcgccccgcctatgcaggcatctgccctctgtgcagactgcgttcccgaggccgcgggctacgcccccacgtctccgcgcccaggccgtgagcaagagtctccgccgccctggccgcctggagcccctgaagcccagcaactcgctgtggccttgggaagggggcgggcccaggaccacgaacaccgccccctcaaccctgcctggcttcgctcccagtggcctcgggggcgcgccgccgcggagactgacgcgaagccccacgctttcgtaagagcgtgcgcgcgcccgaggacgtacgtcatcggcgacggctcccgccggctgggcgtccggtggccggtgtagcagagcggggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgacaataaag

SEQ ID NO: 458937 - DNA, 5014 bp, Homo sapiens
ccttcctcttgggtggtatgttctttttggtgggggcaaggaaaacaagtgatgattttttactccctcctcactgggatacttcccttcctttacgaatgaggaaacagaaaccgaaagaatgttttcctcaaggacgcaccgcgaatttgaggcaggtctcgctgggctgtgtcctttgcagctcgccaagcgcccgtctcccagccctggtccatgcctgggaccagaagtgcagagagccgctgttctcgctccctcccgtcaaacacttgccccacaaggtggcgccggagggtctggaccaccgagggccatgcgggccttggccttggtcctgaagccgtagttttgcttggtccagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaaccggactggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttggtgagagcttcttgggcgggcagacgggcgagagtctcagtggctgggtgggagagaggtgctggcgcgagaccctaccccgacgtgctcagggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccggacgcctgagtctgtgtgtgttggggaaggtgggatggaataaaagtgcccacgagggttgagggaattcttgcagagtgacacgcttaaagtatcctggctcccgtcctggtacacgggctgcgccccgcctatgcaggcatctgccctctgtgcagactgcgttcccgaggccgcgggctacgcccccacgtctccgcgcccaggccgtgagcaagagtctccgccgccctggccgcctggagcccctgaagcccagcaactcgctgtggccttgggaagggggcgggcccaggaccacgaacaccgccccctcaaccctgcctggcttcgctcccagtggcctcgggggcgcgccgccgcggagactgacgcgaagccccacgctttcgtaagagcgtgcgcgcgcccgaggacgtacgtcatcggcgacggctcccgccggctgggcgtccggtggccggtgtagcagagcggggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgacaataaag

SEQ ID NO: 458938 - DNA, 4142 bp, Homo sapiens
ggcggcgcgggtgagaggcgacctgcacccgcctgattgcctccccgcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttggtgagagcttcttgggcgggcagacgggcgagagtctcagtggctgggtgggagagaggtggctcgcgccggcctcctgcctgccctcggggtcctgcgcccgagccctgctgctcgcagaataaaccacggctgccggacgcctgagtctgtgtgtgttggggaaggtgggatggaataaaagtgcccacgagggttgagggaattcttgcagagtgacacgcttaaagtatcctggctcccgtcctggtacacgggctgcgccccgcctatgcaggcatctgccctctgtgcagactgcgttcccgaggccgcgggctacgcccccacgtctccgcgcccaggccgtgagcaagagtctccgccgccctggccgcctggagcccctgaagcccagcaactcgctgtggccttgggaagggggcgggcccaggaccacgaacaccgccccctcaaccctgcctggcttcgctcccagtggcctcgggggcgcgccgccgcggagactgacgcgaagccccacgctttcgtaagagcgtgcgcgcgcccgaggacgtacgtcatcggcgacggctcccgccggctgggcgtccggtggccggtgtagcagagcggggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgacaataaag

SEQ ID NO: 458939 - DNA, 1825 bp, Homo sapiens
gggtccccgaacgccccgcccagcgccgcctcccctcgccttccccgcaggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgacaataaag

SEQ ID NO: 458940 - DNA, 4624 bp, Homo sapiens
ccttcctcttgggtggtatgttctttttggtgggggcaaggaaaacaagtgatgattttttactccctcctcactgggatacttcccttcctttacgaatgaggaaacagaaaccgaaagaatgttttcctcaaggacgcaccgcgaatttgaggcaggtctcgctgggctgtgtcctttgcagctcgccaagcgcccgtctcccagccctggtccatgcctgggaccagaagtgcagagagccgctgttctcgctccctcccgtcaaacacttgccccacaaggtggcgccggagggtctggaccaccgagggccatgcgggccttggccttggtcctgaagccgtagttttgcttggtccagctcctcagtgtctgtcctgcagctggacggggcgccttcaggggccttggctccagtggaagctgcgctggacgagttgcagaggaggatctaccgcttggtgttggaggcgctgcaggcggagctccagcccctgttcgcggatctgccctcgcgccaatggctgtcgagccctgagctcctgcaaagtgtgtgtgaaccggactggggcgcttctgccgggacttctggcgcgtgcggaaccccacggttcagctgctgctggctgaggccgagcgtgccgtggtgctccagtacctgagcgcgctgatgcaaggccgcctggtgtgccgcggagccgacgagaggacccaggcggccgagcgcctgcggcacgatgctgcccagcttcagcagcttttcctcagtttggtgagagcttcttgggcgggcagacgggcgagagtctcagtggctgggtgggagagaggtgctggcgcgagaccctaccccgacgtgctcagggcctggaggagaacgcgcactgcgcgccggtgctgctcgccctgagggagctgctaaacctccgcgaccccgcgctgctgggcctggaggtggctggcctgcggcaacaatttcccgacgtgagcgaggaccacgtctccgccctcttgggcctgcgcggggacttgtcccgggagcagcacctggccgcgctcagctccctgcaggctgcgctgccgccgtcgccccgcgcgagccgccgcgtcctcttcagcctagtgcccgcgcccgcgctcgcgccggcctcctgcctgccctcggggtcctgcgcccgagccctgctgctcgcagaataaaccacggctgccggacgcctgagtctgtgtgtgttggggaaggtgggatggaataaaagtgcccacgagggttgagggaattcttgcagagtgacacgcttaaagtatcctggctcccgtcctggtacacgggctgcgccccgcctatgcaggcatctgccctctgtgcagactgcgttcccgaggccgcgggctacgcccccacgtctccgcgcccaggccgtgagcaagagtctccgccgccctggccgcctggagcccctgaagcccagcaactcgctgtggccttgggaagggggcgggcccaggaccacgaacaccgccccctcaaccctgcctggcttcgctcccagtggcctcgggggcgcgccgccgcggagactgacgcgaagccccacgctttcgtaagagcgtgcgcgcgcccgaggacgtacgtcatcggcgacggctcccgccggctgggcgtccggtggccggtgtagcagagcggggagcggcgggcggcgagcagaggagctaacaggtgggggcacggcacgcggacggacccccccaaaggccgggaggaggcgcgcgacgcgacctttcctgatctcccggagaagcctccactccattgtctcctggccccaccctccattgggcacgcccttcaccttatcccccaccacttattggctgcaggtcacgcccctcctctatttctggttccccattggctcttcaccttgtcctctccggggcttctctccgcacaggccacaccctctcatttgtcactagaccccgccttaatagtggggggctcctcccccatccatccttcattcattatgcacccagtgctgggtgcttggtacacgggggtgaatcagaccccattcctgccttcggggagttcaggggattgtgggaggacacggacctagactccaacagtgacagctctgagtaaagaagtcgccgaagcagtgggacactagacgcggggaaggcttcctggaggaagtgaggcctaaactgagccttgaagaatggttaagagtttgctccaggaatatattgcaaaggcattcttggcggaaggacccgagacgtgaaaaaaacaggcgtattctggtaatttcgaggagaggtcgacagtgtggggagttggagtgacccggctggatgtgacccccaggacagaatggtgctggactcaggggctcaggcgtatgatcaggcaccccccagcccgcctaccagtcccccatccctgcgccataggctgaagccctcagaccgagatgggccaccactgtacccctggtctcagtccctggccttgcccctggctctggcagtccccccagcgctgcagccccagcctgagcagcagccgttctcacagatgctcctgggccaccgtggccacatgcgtcgcagtgagagcacctactctgtaaatagtactggccggcgggggcgtggcaccctgggacggcctccacctggacggggacggaacccaggtgggggcaccctgcggcctgcagcctccctgcctcacattgctaagactcaaagggatgcaggccatattgccagcaagagcccctgcatgttggtggccctgcggccaaccaacatggaccgtgagcgagacaagttcttccagtcccattacacctacaatccacagtttgagtaccaggagcccatgcccacggctgtgctggaaaagtactgcgaggcctctggacagttcatccatcaggcagttggcatcattgaggctgttctggagaagtttggaacctatgaacactttgaggctgccactggggggcagctgctcaccaagtgccagatatggtcgattgtgcgcaaatacatgcagaaggagggctgcgctggggaggttgtggtgcagctgagtgaggacctgctgtcccaggcagtgatgatggtggagaacagccggcccacattggcgatcaacctgaccggagcccgccagtactggttggagggcatgctgcggcatgagataggcacccactacctgcggggcgtgaacaacgcgcgccagccgtggcacaacgcggagggccggctgcggtacgggctgcggccggcgaaccccacggaggagggcctggccagcctgcacagcgtgctgttccgcaagcagccgttcctgtggcgcgctgcactgctctactacaccatccaccgcgccgcgcgcatgtccttccgtcagctcttccaggacctggagcgctacgtgcaggacgccgatgtgcgctgggagtactgcgtgcgcgccaagcgcggccagaccgacacctcgctgccaggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctactttgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgacaataaag

SEQ ID NO: 458941 - DNA, 1524 bp, Homo sapiens
ctgagaaaaactaacttaggctaggtacgaggctcggtgtttaatcggccgaggggttgtttcagcaaggaccaggtgtacctggacggcatcgtgcgcattctgcgacatcgccagaccatcgatttcccgttgctgacctcactgggcaaggtgtcctatgaggatgtggaccacctgcggccccatggggtgctggataatacccgggtgccccacttcatgcaggacttggcacgctaccggcagcagctggagcacatcatggccaccaaccggctggatgaggcggagctgggtcgcctgctacccgactgatgtccgttgagggctgcagtcagaggccctggacagaagctccagataggcccctagaacatgaagcagtttgctctgtgcgtccacggcctaggtgtttcttgggggtgttgggagggcaggagcattccttgaggaggagtggcaacatcaaagtgtttgtgtcccttgccagcctccctggggtctggggacctgcagcagcatgtctggcaaactgagtcgccctcctgcctccagctctctgttgagcagagggaaggcatgggggcaggaagagagctgagcattgatggggatgggggtggtttgggaatagaaacttgttcttgcatgagatggctttggttgtcccagtactccagtctctcccttcccttacctggccccttggtgctccttcagcatttgtgctgtctacctctcactgggtcctggtgggggtcgggctcccttctcctggggtgattgatggcctgagcctggggtcctggtagtagagacccagctggcctggggtctgctttccgacattttgcctctctcactggtcatgtatttattccatatttatatggtctacttcctgtggctgggagcagcagctcctgaaggttccgtgggggtgcggggggttggacaggacactccttcttggaaggcaccaattttcccagccccactcccattacacacacacacacacacacacacacacacacacacacacacacacacacacacacactgattcaggccttgagagtcaagcccaagagctcccttggccctgttccccactccctccactggcctctgctgttcctgtctttgctcacaccctcacagctgctctctggcagaggttggcatagcctaggagcagctgcaattgcacctgagggacaggccctagagtttggtggcccaagtcctgaacccctcttagaccaggtgaggtgcagaggtggttgctgcttccagtttcccttcagacttagctgtgtgaaccccactcctatcctttggccttagttttcccatctgtaaaactcagaaacgcagttggaaagtccttattcatttagtaagcgaatatattataatatgtatagagcgccttttgtgtaagtcactggtcagaatcctcactgagctcccagtccagagagaagccagacaattaaaacagtaatgacaataaag

SEQ ID NO: 458942 - DNA, 801 bp, Homo sapiens
agcctggaacagtacttaaacaagggagcgtgctgtgtgttccagtaaaactggacttgcagaagtggaggtggaggggctggattggctgagggctatcgtttgccaactcctagcttacagtatcacgtacttattgattttttcatccgttatctctgttgatccctccctgatctgtcttctgtttctcaaagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcggggtgcaaaaagaaaatgtgaggtacagtggtcgcctgaagaagcacagaaagcattacagaattgaccataacctgcgtgaaatagtcagagagcaggagactctgccgtggagcctgcgggtgctttcgtgtggagtagggctgtggagattcagaaaaggggacttcactgtgaaccgtagctgcgaagagagcacttgggttggtggcatctaaccatcacttcacctgacaaagggtaatttttctttc

SEQ ID NO: 458943 - DNA, 8491 bp, Homo sapiens
  misc_feature (1567)..(1567): n is a, c, g, or t
ccttccctcgctcccggcttagaggacagcggggaaggcgggcggtggggcacggggcctgaagcggcggtaccggtgctggcggcggcagctgaggccttggccgaagccgcgcgaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggangccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaatgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcaatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtgtggtttgaccgaagaaccaattatacccgttctttagcggtcatgtcaatggttgggtatattttaggcctgggagatagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccacgtaaatcaagccattcattttggggaacagaagatccataactttagaaatacgggttttgacttaactcacaagagaactcatcataaccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacata

SEQ ID NO: 458944 - DNA, 1781 bp, Homo sapiens
agcctggaacagtacttaaacaagggagcgtgctgtgtgttccagtaaaactggacttgcagaagtggaggtggaggggctggattggctgagggctatcgtttgccaactcctagcttacagtatcacgtacttattgattttttcatccgttatctctgttgatccctccctgatctgtcttctgtttctcaaagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccacgtaaatcaagccattcattttggggaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacata

SEQ ID NO: 458945 - DNA, 6965 bp, Homo sapiens
  misc_feature (1567)..(1567): n is a, c, g, or t
ccttccctcgctcccggcttagaggacagcggggaaggcgggcggtggggcacggggcctgaagcggcggtaccggtgctggcggcggcagctgaggccttggccgaagccgcgcgaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggangccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaatgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcaatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctggttggggtatatgttcctggcacagccaattcaaggtcccggcacatcagaagttttggggaaacatattgcagctctaagatgtgagctgaggcagctgctttgagattcgtcgacac

SEQ ID NO: 458946 - DNA, 5995 bp, Homo sapiens
  misc_feature (1567)..(1567): n is a, c, g, or t
ccttccctcgctcccggcttagaggacagcggggaaggcgggcggtggggcacggggcctgaagcggcggtaccggtgctggcggcggcagctgaggccttggccgaagccgcgcgaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggangccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaatgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcaatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacatcagctcattgcaagaattgatgtcctgtgaatggggatcctctag

SEQ ID NO: 458947 - DNA, 5314 bp, Homo sapiens
  misc_feature (1567)..(1567): n is a, c, g, or t
ccttccctcgctcccggcttagaggacagcggggaaggcgggcggtggggcacggggcctgaagcggcggtaccggtgctggcggcggcagctgaggccttggccgaagccgcgcgaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggangccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaatgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcaatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctgggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacata

SEQ ID NO: 458948 - DNA, 353 bp, Homo sapiens
cattaataataagctacagcagccggaggcagcggccggagtgttagaatatgccatgaaacactttggagagctggtaagcacctcattctttttggaaaagcaggaggtagagacttggctagggagttattggccctgaccttcagaaagttactttccttttctgttttttctccaattcataacagtctgatgctgacttaccagtcttcaggatgaaagagataaactgtgtctgtagggactctatttctttcttttttttttttaattatactttaagttctagggtacatgtgcacaacgtgcaggtttgttacatatgtacacatgtgccatgttggtgtgct

SEQ ID NO: 458949 - DNA, 8730 bp, Homo sapiens
  misc_feature (1567)..(1567): n is a, c, g, or t
ccttccctcgctcccggcttagaggacagcggggaaggcgggcggtggggcacggggcctgaagcggcggtaccggtgctggcggcggcagctgaggccttggccgaagccgcgcgaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggangccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaatgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcaatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtgtggtttgaccgaagaaccaattatacccgttctttagcggtcatgtcaatggttgggtatattttaggcctgggagatagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccacgtaaatcaagccattcattttggggaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacata

SEQ ID NO: 458950 - DNA, 3635 bp, Homo sapiens
tccagacctaccccaaatccctcttcttgacaaagctttccaaatgcctgtccttgctactcccattgtgccttgcagagtacctaggtcttcaggtttgtgcgtgagctcccctaggaggccgggagatcccttgaggcaagagctctctcctgctcctcttgctgtgcccttctcgcagtgcactcatagtacgttatatagttagtgctccacaaagtgagtggatcatgttgaatttagtaaaacagccatttctgagtgtctccttgaagtgtttgctttatggacacacagaacaggcaggagcagctgttcctcagcatcgaccttgcgctcctctgagccctgctgttggtcacagctccagtgtctgtccttgcctttctccccaaccaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggttatacctcagctcattgcaagaattgatacgcccagacccttggtgggacgtctcattcaccagcttctcacagacattggtcggtaccacccccaggccctcatctacccactgacagtggcttctaagtctaccacgacagcccggcacaatgcagccaacaagattctgaagaacatgtgtgagcacagcaacaccctggtccagcaggccatgatggtgagcgaggagctgatccgagtggccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcacccaagcctgggacctctattatcatgtgttccgacgaatctcaaagcagctgcctcagctcacatccttagagctgcaatatgtttccccaaaacttctgatgtgccgggaccttgaattggctgtgccaggaacatatgaccccaaccagccaatcattcgcattcagtccatagcaccgtctttgcaagtcatcacatccaagcagaggccccggaaattgacacttatgggcagcaacggacatgagtttgttttccttctaaaaggccatgaagatctgcgccaggatgagcgtgtgatgcagctcttcggcctggttaacacccttctggccaatgacccaacatctcttcggaaaaacctcagcatccagagatacgctgtcatccctttatcgaccaactcgggcctcattggctgggttccccactgtgacacactgcacgccctcatccgggactacagggagaagaagaagatccttctcaacatcgagcatcgcatcatgttgcggatggctccggactatgaccacttgactctgatgcagaaggtggaggtgtttgagcatgccgtcaataatacagctggggacgacctggccaagctgctgtggctgaaaagccccagctccgaggtgtggtttgaccgaagaaccaattatacccgttctttagcggtcatgtcaatggttgggtatattttaggcctgggagatagacacccatccaacctgatgctggaccgtctgagtgggaagatcctgcacattgactttggggactgctttgaggttgctatgacccgagagaagtttccagagaagattccatttagactaacaagaatgttgaccaatgctatggaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccacgtaaatcaagccattcattttggggaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacata

SEQ ID NO: 458951 - DNA, 1562 bp, Homo sapiens
cattctcaccctgatacgtcaacatggcctgtgtctgcttcctaagtgagggtaacagaccccctcggcttgctttgggtggagagttagtaactcctgtggtgagtggctctgtcccatttctaggttacaggcctggatggcaactacagaatcacatgccacacagtgatggaggtgctgcgagagcacaaggacagtgtcatggccgtgctggaagcctttgtctatgaccccttgctgaactggaggctgatggacacaaataccaaaggcaacaagcgatcccgaacgaggacggattcctactctgctggccagtcagtcgaaattttggacggtgtggaacttggagagccagcccataagaaaacggggaccacagtgccagaatctattcattctttcattggagacggtttggtgaaaccagaggccctaaataagaaagctatccagattattaacagggttcgagataagctcactggtcgggacttctctcatgatgacactttggatgttccaacgcaagttgagctgctcatcaaacaagcgacatcccatgaaaacctctgccagtgctatattggctggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccacgtaaatcaagccattcattttggggaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcagggttctgggatgttttcagtggtcaaaatactctgtttagagcaagggctcagaaaacagaaatactgtcatggaggtgctgaacacagggaaggtctggtacatattggaaattatgagcagaacaaatactcaactaaatgcacaaagtataaagtgtagccatgtctagacaccatgttgtatcagaataatttttgtgccaataaatgacatcagaattttaaacata

SEQ ID NO: 458952 - DNA, 5973 bp, Homo sapiens
  misc_feature (1567)..(1567): n is a, c, g, or t
ccttccctcgctcccggcttagaggacagcggggaaggcgggcggtggggcacggggcctgaagcggcggtaccggtgctggcggcggcagctgaggccttggccgaagccgcgcgaacctcagggcaagatgcttggaaccggacctgccgccgccaccaccgctgccaccacatctagcaatgtgagcgtcctgcagcagtttgccagtggcctaaagagccggaatgaggaaaccagggccaaagccgccaaggagctccagcactatgtcaccatggaactccgagagatgagtcaagaggagtctactcgcttctatgaccaactgaaccatcacatttttgaattggtttccagctcagatgccaatgagaggaaaggtggcatcttggccatagctagcctcataggagtggaaggtgggaatgccacccgaattggcagatttgccaactatcttcggaacctcctcccctccaatgacccagttgtcatggaaatggcatccaaggccattggccgtcttgccatggcaggggacacttttaccgctgagtacgtggaatttgaggtgaagcgagccctggaatggctgggtgctgaccgcaatgagggccggagacatgcagctgtcctggttctccgtgagctggccatcagcgtccctaccttcttcttccagcaagtgcaacccttctttgacaacatttttgtggccgtgtgggaccccaaacaggccatccgtgagggagctgtagccgcccttcgtgcctgtctgattctcacaacccagcgtgagccgaaggagatgcagaagcctcagtggtacaggcacacatttgaagaagcagagaagggatttgatgagaccttggccaaagagaagggcatgaatcgggatgatcggatccatggagccttgttgatccttaacgagctggtccgaatcagcagcatggagggagagcgtctgagagaagaaatggaagaaatcacacagcagcagctggtacacgacaagtactgcaaagatctcatgggcttcggaacaaaacctcgtcacattacccccttcaccagtttccaggctgtacagccccagcagtcaaatgccttggtggggctgctggggtacagctctcaccaaggcctcatgggatttgggacctcccccagtccagctaagtccaccctggtggagagccggtgttgcagagacttgatggaggagaaatttgatcaggtgtgccagtgggtgctgaaatgcaggaatagcaagaactcgctgatccaaatgacaatccttaatttgttgccccgcttggctgcattccgaccttctgccttcacagatacccagtatctccaagataccatgaaccatgtcctaagctgtgtcaagaaggagaaggaacgtacagcggccttccaagccctggggctactttctgtggctgtgaggtctgagtttaaggtctatttgcctcgcgtgctggacatcatccgagcggccctgcccccaaaggacttcgcccataagaggcagaaggcaatgcaggtggangccacagtcttcacttgcatcagcatgctggctcgagcaatggggccaggcatccagcaggatatcaaggagctgctggagcccatgctggcagtgggactaagccctgccctcactgcagtgctctacgacctgagccgtcagattccacagctaaagaaggacattcaagatgggctactgaaaatgctgtccctggtccttatgcacaaaccccttcgccacccaggcatgcccaagggcctggcccatcagctggcctctcctggcctcacgaccctccctgaggccagcgatgtgggcagcatcactcttgccctccgaacgcttggcagctttgaatttgaaggccactctctgacccaatttgttcgccactgtgcggatcatttcctgaacagtgagcacaaggagatccgcatggaggctgcccgcacctgctcccgcctgctcacaccctccatccacctcatcagtggccatgctcatgtggttagccagaccgcagtgcaagtggtggcagatgtgcttagcaaactgctcgtagttgggataacagatcctgaccctgacattcgctactgtgtcttggcgtccctggacgagcgctttgatgcacacctggcccaggcggagaacttgcaggccttgtttgtggctctgaatgaccaggtgtttgagatccgggagctggccatctgcactgtgggccgactcagtagcatgaaccctgcctttgtcatgcctttcctgcgcaagatgctcatccagattttgacagagttggagcacagtgggattggaagaatcaaagagcagagtgcccgcatgctggggcacctggtctccaatgccccccgactcatccgcccctacatggagcctattctgaaggcattaattttgaaactgaaagatccagaccctgatccaaacccaggtgtgatcaataatgtcctggcaacaataggagaattggcacaggttagtggcctggaaatgaggaaatgggttgatgaactttttattatcatcatggacatgctccaggattcctctttgttggccaaaaggcaggtggctctgtggaccctgggacagttggtggccagcactggctatgtagtagagccctacaggaagtaccctactttgcttgaggtgctactgaattttctgaagactgagcagaaccagggtacacgcagagaggccatccgtgtgttagggcttttaggggctttggatccttacaagcacaaagtgaacattggcatgatagaccagtcccgggatgcctctgctgtcagcctgtcagaatccaagtcaagtcaggattcctctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaatgtcattcgagtctgtgatggggccatccgggaatttttgttccagcagctgggaatgttggtgtcctttgtgaagagccacatcagaccttatatggatgaaatagtcaccctcatgagagaattctgggtcatgaacacctcaattcagagcacgatcattcttctcattgagcaaattgtggtagctcttgggggtgaatttaagctctacctgccccagctgatcccacacatgctgcgtgtcttcatgcatgacaacagcccaggccgcattgtctctatcaagttactggctgcaatccagctgtttggcgccaacctggatgactacctgcatttactgctgcctcctattgttaagttgtttgatgcccctgaagctccactgccatctcgaaaggcagcgctagagactgtggaccgcctgacggagtccctggatttcactgactatgcctcccggatcattcaccctattgttcgaacactggaccagagcccagaactgcgctccacagccatggacacgctgtcttcacttgtttttcagctggggaagaagtaccaaattttcattccaatggtgaataaagttctggtgcgacaccgaatcaatcatcagcgctatgatgtgctcatctgcagaattgtcaagggatacacacttgctgatgaagaggaggatcctttgatttaccagcatcggatgcttaggagtggccaaggggatgcattggctagtggaccagtggaaacaggacccatgaagaaactgcacgtcagcaccatcaacctccaaaaggcctggggcgctgccaggagggtctccaaagatgactggctggaatggctgagacggctgagcctggagctgctgaaggactcatcatcgccctccctgcgctcctgctgggccctggcacaggcctacaacccgatggccagggatctcttcaatgctgcatttgtgtcctgctggtctgaactgaatgaagatcaacaggatgagctcatcagaagcatcgagttggccctcacctcacaagacatcgctgaagtcacacagaccctcttaaacttggctgaattcatggaacacagtgacaagggccccctgccactgagagatgacaatggcattgttctgctgggtgagagagctgccaagtgccgagcatatgccaaagcactacactacaaagaactggagttccagaaaggccccacccctgccattctagaatctctcatcagcattaataataagctacagcagccggaggcagcggccggagtgttagaatatgccatgaaacactttggagagctggagatccaggctacctggtatgagaaactgcacgagtgggaggatgcccttgtggcctatgacaagaaaatggacaccaacaaggacgacccagagctgatgctgggccgcatgcgctgcctcgaggccttgggggaatggggtcaactccaccagcagtgctgtgaaaagtggaccctggttaatgatgagacccaagccaagatggcccggatggctgctgcagctgcatggggtttaggtcagtgggacagcatggaagaatacacctgtatgatccctcgggacacccatgatggggcattttatagagctgtgctggcactgcatcaggacctcttctccttggcacaacagtgcattgacaaggccagggacctgctggatgctgaattaactgcaatggcaggagagagttacagtcgggcatatggggccatggtttcttgccacatgctgtccgagctggaggaggttatccagtacaaacttgtccccgagcgacgagagatcatccgccagatctggtgggagagactgcagggctgccagcgtatcgtagaggactggcagaaaatccttatggtgcggtcccttgtggtcagccctcatgaagacatgagaacctggctcaagtatgcaagcctgtgcggcaagagtggcaggctggctcttgctcataaaactttagtgttgctcctgggagttgatccgtctcggcaacttgaccatcctctgccaacagttcaccctcaggtgacctatgcctacatgaaaaacatgtggaagagtgcccgcaagatcgatgccttccagcacatgcagcattttgtccagaccatgcagcaacaggcccagcatgccatcgctactgaggaccagcagcataagcaggaactgcacaagctcatggcccgatgcttcctgaaacttggagagtggcagctgaatctacagggcatcaatgagagcacaatccccaaagtgctgcagtactacagcgccgccacagagcacgaccgcagctggtacaaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggatctgtccaaaaccctcctgatgtacacggtgcctgccgtccagggcttcttccgttccatctccttgtcacgaggcaacaacctccaggatacactcagagttctcaccttatggtttgattatggtcactggccagatgtcaatgaggccttagtggagggggtgaaagccatccagattgatacctggctacaggtgaggatacttggttacaggtgaaggtggct

SEQ ID NO: 458953 - DNA, 445 bp, Homo sapiens
aaagccaaaaaccgtttactccttgatggtgagaggctattcattggttcctaatagaccttgaactcccaacagtgttagaacatactaggaagaaagatatgaatgctaatgtctgttaggaggttgtttgttactaaccatgctctgcctgaagtcacgtcatgccatgtgtagctctaacactctctgttgttttgtcctagctgactatagcactagtgaaatgctggtcaacatgggaaacttgcctctggatgagttctacccagctgtgtccatggtggccctgatgcggatcttccgagaccagtcactctctcatcatcacaccatggttgtccaggccatcaccttcatcttcaagtccctgggactcaaatgtgtgcagttcctgccccaggtcatgcccacgttccttaatgtcattcgagtctgtgatggg

SEQ ID NO: 458954 - DNA, 1518 bp, Homo sapiens
cgccgtccttctcgcgcctcgcttctggccctgcaggttgtgtttccgcctctaccccgcctccattccgttgctctctcagtctcagacccgggctctcggtccgccgcttcaggtcttggcgcagcctcagagagttggcgcggctctgtgttgaccaaacctagtggatgcagttagcgccggagcccggccccgcccgtcaccagggttattcccgccttctaggtttgccaggactgccggccctgcagctgccttctgccccaggtttttggctactgatgttacaaacaataaaatattggagcatagagttgaagaacagactcaaaccaggtttttatttaattagttaaaaatatggatcctgagacaaggggacaagagattatcaaagtgacacctcttcaacaaatgcttgcctcatgtactggagctatactgacatcagtaatagtgacacccctggatgttgttaaaattagactccaagcccaaaacaacccactccccaaaggaaaatgttttgtatatagtaatggactcatggatcatctatgtgtctgtgaagagggaggcaacaaactatggtataagaagccaggaaatttccagggaacattggatgcattttttaaaatcattcgaaatgagggcattaaatctctatggagtggccttcctcctaccctagtgatggcagttcctgccacagttatttattttacctgctatgatcaattaagtgctcttctgagatctaagttaggagaaaatgaaacctgcataccaattgttgctggaattgtagccagatttggtgcagtaactgtgataagtccactagaattgattagaaccaagatgcagtccaagaagttttcttacgtggaactgcatcgatttgtcagcaagaaagtatctgaagatggttggatttccctttggaggggctgggctcctactgttcttagagatgtacctttctcagcaatgtactggtataactatgaaattttaaagaagtggttatgtgagaaatctggtttatatgagccaacatttatgatcaactttacttcaggggcattgtctggttcttttgctgctgttgcaactttaccatttgatgtagtaaaaacacaaaagcagacacaactttggacatatgaaagtcataaaatttctatgcctttgcatatgtcaacctggattataatgaagaacattgttgctaaaaatggattttccggattattttcaggcctaattcctcgcttaattaaaattgctcctgcttgtgccattatgatcagtacatatgaatttggaaaggcttttttccagaaacaaaatgttcgaaggcagcaatactagtgatgctgtttcaacttgaaacaacaactatagccaaagaagatggagactcttaggcaagaatgtttttcaccattattctctcacaatgattttatgtctttctttcctataatttaaataaataatttcagctct

SEQ ID NO: 458955 - DNA, 441 bp, Homo sapiens
aaattaatcaattttactttctgatagtttgctgctgttgcaactttaccatttgatgtagtaaaaacacaaaagcagacacaactttggacatatgaaagtcataaaatttctatgcctttgcatatgtcaacctggattataatgaagaacattgttgctaaaaatggattttccggattattttcaggcctaattcctcgcttaattaaaattgctcctgcttgtgccattatgatcagtacatatgaatttggaaaggcttttttccagaaacaaaatgttcgaaggcagcaatactagtgatgctgtttcaacttgaaacaacaactatagccaaagaagatggagactcttaggcaagaatgtttttcaccattattctctcacaatgattttatgtctttctttcctataatttaaataaataatttcagctct

SEQ ID NO: 458956 - DNA, 4177 bp, Homo sapiens
  misc_feature (3393)..(3393): n is a, c, g, or t
cgccgtccttctcgcgcctcgcttctggccctgcaggttgtgtttccgcctctaccccgcctccattccgttgctctctcagtctcagacccgggctctcggtccgccgcttcaggtcttggcgcagcctcagagagttggcgcggctctgtgttgaccaaacctagtggatgcagttagcgccggagcccggccccgcccgtcaccagggttattcccgccttctaggtttgccaggactgccggccctgcagctgccttctgccccaggtttttggctactgatgttacaaacaataaaatattggagcatagagttgaagaacagactcaaaccaggtttttatttaattagttaaaaatatggatcctgagacaaggggacaagagattatcaaagtgacacctcttcaacaaatgcttgcctcatgtactggagctatactgacatcagtaatagtgacacccctggatgttgttaaaattagactccaagcccaaaacaacccactccccaaaggaaaatgttttgtatatagtaatggactcatggatcatctatgtgtctgtgaagagggaggcaacaaactatggtataagaagccaggaaatttccagggaacattggatgcattttttaaaatcattcgaaatgagggcattaaatctctatggagtggccttcctcctaccctagtgatggcagttcctgccacagttatttattttacctgctatgatcaattaagtgctcttctgagatctaagttaggagaaaatgaaacctgcataccaattgttgctggaattgtagccagatttggtgcagtaactgtgataagtccactagaattgattagaaccaagatgcagtccaagaagttttcttacgtggaactgcatcgatttgtcagcaagaaagtatctgaagatggttggatttccctttggaggggctgggctcctactgttcttagagatgtacctttctcagcaatgtactggtataactatgaaattttaaagaagtggttatgtgagaaatctggtttatatgagccaacatttatgatcaactttacttcaggggcattgtctggttctgaataatagaacacaaaggagcgtgagaaattgtgaatgctggtagtggagtcagagaggcttggttggaattgtggctctgcaactagtagctgtgtgacctcaggaaatttgctgctgttgcaactttaccatttgatgtagtaaaaacacaaaagcagacacaactttggacatatgaaagtcataaaatttctatgcctttgcatatgtcaacctggattataatgaagaacattgttgctaaaaatggattttccggattattttcaggcctaattcctcgcttaattaaaattgctcctgcttgtgccattatgatcagtacatatgaatttggaaaggcttttttccagaaacaaaatgttcgaaggcagcaatactagtgatgctgtttcaacttgaaacaacaactatagccaaagaagatggagactcttaggcaagaatgtttttcaccattattctctcacaatgattttatgtctttctttcctataatttaaataaataatttcagctctacctctaaatcataattttaaaataaattttatcttatttttggtgatattgaaaaagatattctagaaatcaccaccattgagcattcttgtaaaaatagattactccttagcatcaaaagcagtctcttgaaagtttaatattatatgtttcagtgtaacataatcttactgggagtgtgttgaatacaccagaactttttgaattgtgtgctgaatgatgtacatagtctagaagaaaaaagcccaagtcttgtgcacatttaaatcgtgtacataagtatttccgtatttcagtaaagtagataaagcactcgttaaatagcattgtttacatcgaccaaatattgcctgtttcctttaattcaaatgcattaggttcccgcctccctctccttccccgccatgttgctgttttaaggcttcatatgtattaacatttctctgatcaaaattgtggctgttttccttatgaaccataatataatcatttgtgtgatgtacattgtgccatttttgatgactaaatgtctatatttctgccattcctgtaagagagggagttttttactgatagtagcaaatgttcacttcagtcaaacttgggtgttcagtggtaaaccatatagtatttagactggtaaaaatagtttgcacacaggaatagcctctgatttttagctctcttgtaatccaagtatcattgttcatggaattctctaggtcatttttattgtgttgttctaacaagacagattattgctacaacaatagttacaagatatttctaaaatatcctttgatttttactctaagtatggtagagtaagaggctaaacaagaagctgtttccttgaagacattgctttcagtcaccatacatgtctaaataatttagcttatcattcattctatgtaggaatgagataagaaaggatatgatggcaggaaaagaaatgctattcattttttatactttagttttattttcttaggatctatatcctatatatatatattttttaaagcactaatttattgcagtctttattttagaaaaatgtgaagcatttttttctcccctaaaatgaatatatttagatgacaagtctttagtgctggtagaggaactaattgattttgtactatagtaggaaagtgtttatatgtttcaccagaaataaaatatgtagggtttgtatgtaatcttctgtgtttatcctatgttgatttaccttaaatttgcaacatacatatccacataaatattcatgactttcttatatttcattaaaatgttttatggcttcttaaaatcatcactgtgcttctaaatatttttacgtaaaatcattgtataatgctatactgtgatatacatgaaagtttatcttgaacagtgctctttaacaatattaaatttaaatttatcttggttttgctatgcttatgggtaattcatagaaaacagaaaaaatactgttcccaaaaggcagttatatatttcagtttaatatcacctataagtatgagaaaggtttccatgtctcctacccctcactgcacttaggaaaattcttatttatgaataaagtaagataagtaaatctaattgcctagtcgtttttttaacacatatacatgcaatgtatctggatgaatagaaggctgaattgaagctttctttatatttaagaggtaaaaagaaatattaatacttttaaaatatactaacaaccaaaaagtgttcagaattttgctatantaataatttgtattaaaatagtacctagaaaaattcagtctatggaataggtaaaattttaaaattttaatttgctctcagagttctgtctgataaaataattgaactataattggcatgatgaatattcccaggttttacttcagtatataaatttaactctcagccacatgggctttccagacttttcaatacatatgatgttgcaggaattgcaatatttgcaaacatgtgccacaacagtgttcttggtgatgtttctaaaacagtttttattctattaatgttaaattttctaacataaacatttaattgattaatgtaaaattttaggaaggaacatctttaattttcaatatgagatggttgcaacctttaaagtagtacatatttgattttttttaaaaggcaatatttttttttctaggaaaactattcattatggttatttaactgcatatgttttttaaatttttccctcttggaacaacatgtactggggcctatcaaagggtggagggtgggaggagggagaggaacaggaaaaataactaatgggtactaggcttaatacctgggtgatgaaataatctgtataataaatccccatgacacaaaagtttacctgtgtaacaaacctgcatatgtacccctaaacttaaattcttccctctttttgtcttgggcacaagtttttgggatatggaaaagtttattgtatcccttttgaattttcttctaagatgaactttttaaataaaagatattactgcttttatattta

SEQ ID NO: 458957 - DNA, 3122 bp, Homo sapiens
cgccgtccttctcgcgcctcgcttctggccctgcaggttgtgtttccgcctctaccccgcctccattccgttgctctctcagtctcagacccgggctctcggtccgccgcttcaggtcttggcgcagcctcagagagttggcgcggctctgtgttgaccaaacctagtggatgcagttagcgccggagcccggccccgcccgtcaccagggttattcccgccttctaggtttgccaggactgccggccctgcagctgccttctgccccaggtttttggctactgatgttacaaacaataaaatattggagcatagagttgaagaacagactcaaaccaggtttttatttaattagttaaaaatatggatcctgagacaaggggacaagagattatcaaagtgacacctcttcaacaaatgcttgcctcatgtactggagctatactgacatcagtaatagtgacacccctggatgttgttaaaattagactccaagcccaaaacaacccactccccaaaggaaaatgttttgtatatagtaatggactcatggatcatctatgtgtctgtgaagagggaggcaacaaactatggtataagaagccaggaaatttccagggaacattggatgcattttttaaaatcattcgaaatgagggcattaaatctctatggagtggccttcctcctaccctagtgatggcagttcctgccacagttatttattttacctgctatgatcaattaagtgctcttctgagatctaagttaggagaaaatgaaacctgcataccaattgttgctggaattgtagccagatttggtgcagtaactgtgataagtccactagaattgattagaaccaagatgcagtccaagaagttttcttacgtggaactgcatcgatttgtcagcaagaaagtatctgaagatggttggatttccctttggaggggctgggctcctactgttcttagagatgtacctttctcagcaatgtactggtataactatgaaattttaaagaagtggttatgtgagaaatctggtttatatgagccaacatttatgatcaactttacttcaggggcattgtctggttcttttgctgctgttgcaactttaccatttgatgtagtaaaaacacaaaagcagacacaactttggacatatgaaagtcataaaatttctatgcctttgcatatgtcaacctggattataatgaagaacattgttgctaaaaatggattttccggattattttcaggcctaattcctcgcttaattaaaattgctcctgcttgtgccattatgatcagtacatatgaatttggaaaggcttttttccagaaacaaaatgttcgaaggcagcaatactagtgatgctgtttcaacttgaaacaacaactatagccaaagaagatggagactcttaggcaagaatgtttttcaccattattctctcacaatgattttatgtctttctttcctataatttaaataaataatttcagctctacctctaaatcataattttaaaataaattttatcttatttttggtgatattgaaaaagatattctagaaatcaccaccattgagcattcttgtaaaaatagattactccttagcatcaaaagcagtctcttgaaagtttaatattatatgtttcagtgtaacataatcttactgggagtgtgttgaatacaccagaactttttgaattgtgtgctgaatgatgtacatagtctagaagaaaaaagcccaagtcttgtgcacatttaaatcgtgtacataagtatttccgtatttcagtaaagtagataaagcactcgttaaatagcattgtttacatcgaccaaatattgcctgtttcctttaattcaaatgcattaggttcccgcctccctctccttccccgccatgttgctgttttaaggcttcatatgtattaacatttctctgatcaaaattgtggctgttttccttatgaaccataatataatcatttgtgtgatgtacattgtgccatttttgatgactaaatgtctatatttctgccattcctgtaagagagggagttttttactgatagtagcaaatgttcacttcagtcaaacttgggtgttcagtggtaaaccatatagtatttagactggtaaaaatagtttgcacacaggaatagcctctgatttttagctctcttgtaatccaagtatcattgttcatggaattctctaggtcatttttattgtgttgttctaacaagacagattattgctacaacaatagttacaagatatttctaaaatatcctttgatttttactctaagtatggtagagtaagaggctaaacaagaagctgtttccttgaagacattgctttcagtcaccatacatgtctaaataatttagcttatcattcattctatgtaggaatgagataagaaaggatatgatggcaggaaaagaaatgctattcattttttatactttagttttattttcttaggatctatatcctatatatatatattttttaaagcactaatttattgcagtctttattttagaaaaatgtgaagcatttttttctcccctaaaatgaatatatttagatgacaagtctttagtgctggtagaggaactaattgattttgtactatagtaggaaagtgtttatatgtttcaccagaaataaaatatgtagggtttgtatgtaatcttctgtgtttatcctatgttgatttaccttaaatttgcaacatacatatccacataaatattcatgactttcttatatttcattaaaatgttttatggcttcttaaaatcatcactgtgcttctaaatatttttacgtaaaatcattgtataatgctatactgtgatatacatgaaagtttatcttgaacagtgctctttaacaatattaaatttaaatttatcttggttttgctatgcttatgggtaattcatagaaaacagaaaaaatactgttcccaaaaggcagttatatatttcagtttaatatcacctataagtatgagaaaggtttccatgtctcctacccctcactgcacttaggaaaattcttatttatgaataaagtaagataagt

SEQ ID NO: 458958 - DNA, 1878 bp, Homo sapiens
  misc_feature (1847)..(1847): n is a, c, g, or t
  misc_feature (1849)..(1849): n is a, c, g, or t
  misc_feature (1854)..(1855): n is a, c, g, or t
  misc_feature (1861)..(1861): n is a, c, g, or t
  misc_feature (1873)..(1873): n is a, c, g, or t
cgccgtccttctcgcgcctcgcttctggccctgcaggttgtgtttccgcctctaccccgcctccattccgttgctctctcagtctcagacccgggctctcggtccgccgcttcaggtcttggcgcagcctcagagagttggcgcggctctgtgttgaccaaacctagtggatgcagttagcgccggagcccggccccgcccgtcaccagggttattcccgccttctaggtttgccaggactgccggccctgcagctgccttctgccccaggtttttggctactgatgttacaaacaataaaatattggagcatagagttgaagaacagactcaaaccaggtttttatttaattagttaaaaatatggatcctgagacaaggggacaagagattatcaaagtgacacctcttcaacaaatgcttgcctcatgtactggagctatactgacatcagtaatagtgacacccctggatgttgttaaaattagactccaagcccaaaacaacccactccccaaaggaaaatgttttgtatatagtaatggactcatggatcatctatgtgtctgtgaagagggaggcaacaaactatggtataagaagccaggaaatttccagggaacattggatgcattttttaaaatcattcgaaatgagggcattaaatctctatggagtggccttcctcctaccctagtgatggcagttcctgccacagttatttattttacctgctatgatcaattaagtgctcttctgagatctaagttaggagaaaatgaaacctgcataccaattgttgctggaattgtagccagatttggtgcagtaactgtgataagtccactagaattgattagaaccaagatgcagtccaagaagttttcttacgtggaactgcatcgatttgtcagcaagaaagtatctgaagatggttggatttccctttggaggggctgggctcctactgttcttagagatgtacctttctcagcaatgtactggtataactatgaaattttaaagaagtggttatgtgagaaatctggtttatatgagccaacatttatgatcaactttacttcaggggcattgtctggttcttttgctgctgttgcaactttaccatttgatgtagtaaaaacacaaaagcagacacaactttggacatatgaaagtcataaaatttctatgcctttgcatatgtcaacctggattataatgaagaacattgttgctaaaaatggattttccggattattttcaggcctaattcctcgcttaattaaaattgctcctgcttgtgccattatgatcagtacatatgaatttggaaaggcttttttccagaaacaaaatgttcgaaggcagcaatactagtgatgctgtttcaacttgaaacaacaactatagccaaagaagatggagactcttaggcaagaatgtttttcaccattattctctcacaatgattttatgtctttctttcctataatttaaataaataatttcagctctacctctaaatcataattttaaaataaattttatcttatttttggtgatattgaaaaagatattctagaaatcaccaccattgagcattcttgtaaaaatagattactccttagcatcaaaagcagtctcttgaaagtttaatattatatgtttcagtgtaacataatcttactgggagtgtgttgaatacaccagaactttttgaattgtgtgctgaatgatgtacatagtctagaagaaaaaagcccaagtcttgtgcacatttaaatcgtgtacataagtatttccgtatttcagtaaagtagataccacaggcccaagatgagggnancgagnncgactnacgtaatcgggntcaaa

SEQ ID NO: 458959 - DNA, 1456 bp, Homo sapiens
cgccgtccttctcgcgcctcgcttctggccctgcaggttgtgtttccgcctctaccccgcctccattccgttgctctctcagtctcagacccgggctctcggtccgccgcttcaggtcttggcgcagcctcagagagttggcgcggctctgtgttgaccaaacctagtggatgcagttagcgccggagcccggccccgcccgtcaccagggttattcccgccttctaggtttgccaggactgccggccctgcagctgccttctgccccaggtttttggctactgatgttacaaacaataaaatattggagcatagagttgaagaacagactcaaaccaggtttttatttaattagttaaaaatatggatcctgagacaaggggacaagagattatcaaagtgacacctcttcaacaaatgcttgcctcatgtactggagctatactgacatcagtaatagtgacacccctggatgttgttaaaattagactccaagcccaaaacaacccactccccaaaggaaaatgttttgtatatagtaatggactcatggatcatctatgtgtctgtgaagagggaggcaacaaactatggtataagaagccaggaaatttccagggaacattggatgcattttttaaaatcattcgaaatgagggcattaaatctctatggagtggccttcctcctaccctagtgatggcagttcctgccacagttatttattttacctgctatgatcaattaagtgctcttctgagatctaagttaggagaaaatgaaacctgcataccaattgttgctggaattgtagccagatttttcttacgtggaactgcatcgatttgtcagcaagaaagtatctgaagatggttggatttccctttggaggggctgggctcctactgttcttagagatgtacctttctcagcaatgtactggtataactatgaaattttaaagaagtggttatgtgagaaatctggtttatatgagccaacatttatgatcaactttacttcaggggcattgtctggttcttttgctgctgttgcaactttaccatttgatgtagtaaaaacacaaaagcagacacaactttggacatatgaaagtcataaaatttctatgcctttgcatatgtcaacctggattataatgaagaacattgttgctaaaaatggattttccggattattttcaggcctaattcctcgcttaattaaaattgctcctgcttgtgccattatgatcagtacatatgaatttggaaaggcttttttccagaaacaaaatgttcgaaggcagcaatactagtgatgctgtttcaacttgaaacaacaactatagccaaagaagatggagactcttaggcaagaatgtttttcaccattattctctcacaatgattttatgtctttctttcctataatttaaataaataatttcagctct

SEQ ID NO: 458960 - DNA, 760 bp, Homo sapiens
aaataagcgagatgttattattagctaaaataaaccctttgaaggagacagcactggtctaatttatttcaagaatagcgtatccattcagaaaggtagtaataactcaggacactgctagggagaatgagctgttttcctcagaaactccttttagaaaaaaaaagttttaaaactatttacaataaaatgtgaatgaaaaaatggttgtgaggacttttctttggcattggataccccatgaaggtttctatacactttttaagagataggggtctcacttaagagttcaagaccaggctggtcttgaactcttaagctcaagagatcgatcttcccacctcagcctcccaagtagctgtcttttaaaaatttcattatgaaaaatttttaagacctagaaaaagtttaaaaaataactaccatcaagtttaagaaacaagcattatcaagtcaggagaaaccttcagtacattcctccttaattgcatccagtcctatacatctttaaacatacagcctttttctgtttattatttttaatgaatctaactattaaaaataaaacttaaagtagctttttaggtaaacaaacctcttcttatggtaaagaaatgatatatccgcaagggccatggacactatgttatctgtagtaggaattattaaattgttatttataatagcattatttctttattttaacatttagtttctatgcctttgcatatgtcaacctggattataatgaagaacattg

SEQ ID NO: 458961 - DNA, 225 bp, Homo sapiens
gaaggatgttatcatttttgaaagatcagaggatgtgctctaattttatgttttctttttaacaggtttttatttaattagttaaaaatatggatcctgagacaaggggacaagagattatcaaagtgacacctcttcaacaaatgcttgcctcatgtactggagctatactgacatcagtaataggtaaaattatgttactgatgtagattatgtaactttgaa

SEQ ID NO: 458962 - DNA, 4067 bp, Homo sapiens
  misc_feature (3283)..(3283): n is a, c, g, or t
cgccgtccttctcgcgcctcgcttctggccctgcaggttgtgtttccgcctctaccccgcctccattccgttgctctctcagtctcagacccgggctctcggtccgccgcttcaggtcttggcgcagcctcagagagttggcgcggctctgtgttgaccaaacctagtggatgcagttagcgccggagcccggccccgcccgtcaccagggttattcccgccttctaggtttgccaggactgccggccctgcagctgccttctgccccaggtttttggctactgatgttacaaacaataaaatattggagcatagagttgaagaacagactcaaaccaggtttttatttaattagttaaaaatatggatcctgagacaaggggacaagagattatcaaagtgacacctcttcaacaaatgcttgcctcatgtactggagctatactgacatcagtaatagtgacacccctggatgttgttaaaattagactccaagcccaaaacaacccactccccaaaggaaaatgttttgtatatagtaatggactcatggatcatctatgtgtctgtgaagagggaggcaacaaactatggtataagaagccaggaaatttccagggaacattggatgcattttttaaaatcattcgaaatgagggcattaaatctctatggagtggccttcctcctaccctagtgatggcagttcctgccacagttatttattttacctgctatgatcaattaagtgctcttctgagatctaagttaggagaaaatgaaacctgcataccaattgttgctggaattgtagccagatttggtgcagtaactgtgataagtccactagaattgattagaaccaagatgcagtccaagaagttttcttacgtggaactgcatcgatttgtcagcaagaaagtatctgaagatggttggatttccctttggaggggctgggctcctactgttcttagagatgtacctttctcagcaatgtactggtataactatgaaattttaaagaagtggttatgtgagaaatctggtttatatgagccaacatttatgatcaactttacttcaggggcattgtctggttcttttgctgctgttgcaactttaccatttgatgtagtaaaaacacaaaagcagacacaactttggacatatgaaagtcataaaatttctatgcctttgcatatgtcaacctggattataatgaagaacattgttgctaaaaatggattttccggattattttcaggcctaattcctcgcttaattaaaattgctcctgcttgtgccattatgatcagtacatatgaatttggaaaggcttttttccagaaacaaaatgttcgaaggcagcaatactagtgatgctgtttcaacttgaaacaacaactatagccaaagaagatggagactcttaggcaagaatgtttttcaccattattctctcacaatgattttatgtctttctttcctataatttaaataaataatttcagctctacctctaaatcataattttaaaataaattttatcttatttttggtgatattgaaaaagatattctagaaatcaccaccattgagcattcttgtaaaaatagattactccttagcatcaaaagcagtctcttgaaagtttaatattatatgtttcagtgtaacataatcttactgggagtgtgttgaatacaccagaactttttgaattgtgtgctgaatgatgtacatagtctagaagaaaaaagcccaagtcttgtgcacatttaaatcgtgtacataagtatttccgtatttcagtaaagtagataaagcactcgttaaatagcattgtttacatcgaccaaatattgcctgtttcctttaattcaaatgcattaggttcccgcctccctctccttccccgccatgttgctgttttaaggcttcatatgtattaacatttctctgatcaaaattgtggctgttttccttatgaaccataatataatcatttgtgtgatgtacattgtgccatttttgatgactaaatgtctatatttctgccattcctgtaagagagggagttttttactgatagtagcaaatgttcacttcagtcaaacttgggtgttcagtggtaaaccatatagtatttagactggtaaaaatagtttgcacacaggaatagcctctgatttttagctctcttgtaatccaagtatcattgttcatggaattctctaggtcatttttattgtgttgttctaacaagacagattattgctacaacaatagttacaagatatttctaaaatatcctttgatttttactctaagtatggtagagtaagaggctaaacaagaagctgtttccttgaagacattgctttcagtcaccatacatgtctaaataatttagcttatcattcattctatgtaggaatgagataagaaaggatatgatggcaggaaaagaaatgctattcattttttatactttagttttattttcttaggatctatatcctatatatatatattttttaaagcactaatttattgcagtctttattttagaaaaatgtgaagcatttttttctcccctaaaatgaatatatttagatgacaagtctttagtgctggtagaggaactaattgattttgtactatagtaggaaagtgtttatatgtttcaccagaaataaaatatgtagggtttgtatgtaatcttctgtgtttatcctatgttgatttaccttaaatttgcaacatacatatccacataaatattcatgactttcttatatttcattaaaatgttttatggcttcttaaaatcatcactgtgcttctaaatatttttacgtaaaatcattgtataatgctatactgtgatatacatgaaagtttatcttgaacagtgctctttaacaatattaaatttaaatttatcttggttttgctatgcttatgggtaattcatagaaaacagaaaaaatactgttcccaaaaggcagttatatatttcagtttaatatcacctataagtatgagaaaggtttccatgtctcctacccctcactgcacttaggaaaattcttatttatgaataaagtaagataagtaaatctaattgcctagtcgtttttttaacacatatacatgcaatgtatctggatgaatagaaggctgaattgaagctttctttatatttaagaggtaaaaagaaatattaatacttttaaaatatactaacaaccaaaaagtgttcagaattttgctatantaataatttgtattaaaatagtacctagaaaaattcagtctatggaataggtaaaattttaaaattttaatttgctctcagagttctgtctgataaaataattgaactataattggcatgatgaatattcccaggttttacttcagtatataaatttaactctcagccacatgggctttccagacttttcaatacatatgatgttgcaggaattgcaatatttgcaaacatgtgccacaacagtgttcttggtgatgtttctaaaacagtttttattctattaatgttaaattttctaacataaacatttaattgattaatgtaaaattttaggaaggaacatctttaattttcaatatgagatggttgcaacctttaaagtagtacatatttgattttttttaaaaggcaatatttttttttctaggaaaactattcattatggttatttaactgcatatgttttttaaatttttccctcttggaacaacatgtactggggcctatcaaagggtggagggtgggaggagggagaggaacaggaaaaataactaatgggtactaggcttaatacctgggtgatgaaataatctgtataataaatccccatgacacaaaagtttacctgtgtaacaaacctgcatatgtacccctaaacttaaattcttccctctttttgtcttgggcacaagtttttgggatatggaaaagtttattgtatcccttttgaattttcttctaagatgaactttttaaataaaagatattactgcttttatattta

SEQ ID NO: 458963 - DNA, 4022 bp, Homo sapiens
  misc_feature (3238)..(3238): n is a, c, g, or t
cgccgtccttctcgcgcctcgcttctggccctgcaggttgtgtttccgcctctaccccgcctccattccgttgctctctcagtctcagacccgggctctcggtccgccgcttcaggtcttggcgcagcctcagagagttggcgcggctctgtgttgaccaaacctagtggatgcagttagcgccggagcccggccccgcccgtcaccagggttattcccgccttctaggtttgccaggactgccggccctgcagctgccttctgccccaggtttttggctactgatgttacaaacaataaaatattggagcatagagttgaagaacagactcaaaccaggtttttatttaattagttaaaaatatggatcctgagacaaggggacaagagattatcaaagtgacacctcttcaacaaatgcttgcctcatgtactggagctatactgacatcagtaatagtgacacccctggatgttgttaaaattagactccaagcccaaaacaacccactccccaaaggaaaatgttttgtatatagtaatggactcatggatcatctatgtgtctgtgaagagggaggcaacaaactatggtataagaagccaggaaatttccagggaacattggatgcattttttaaaatcattcgaaatgagggcattaaatctctatggagtggccttcctcctaccctagtgatggcagttcctgccacagttatttattttacctgctatgatcaattaagtgctcttctgagatctaagttaggagttggtgcagtaactgtgataagtccactagaattgattagaaccaagatgcagtccaagaagttttcttacgtggaactgcatcgatttgtcagcaagaaagtatctgaagatggttggatttccctttggaggggctgggctcctactgttcttagagatgtacctttctcagcaatgtactggtataactatgaaattttaaagaagtggttatgtgagaaatctggtttatatgagccaacatttatgatcaactttacttcaggggcattgtctggttcttttgctgctgttgcaactttaccatttgatgtagtaaaaacacaaaagcagacacaactttggacatatgaaagtcataaaatttctatgcctttgcatatgtcaacctggattataatgaagaacattgttgctaaaaatggattttccggattattttcaggcctaattcctcgcttaattaaaattgctcctgcttgtgccattatgatcagtacatatgaatttggaaaggcttttttccagaaacaaaatgttcgaaggcagcaatactagtgatgctgtttcaacttgaaacaacaactatagccaaagaagatggagactcttaggcaagaatgtttttcaccattattctctcacaatgattttatgtctttctttcctataatttaaataaataatttcagctctacctctaaatcataattttaaaataaattttatcttatttttggtgatattgaaaaagatattctagaaatcaccaccattgagcattcttgtaaaaatagattactccttagcatcaaaagcagtctcttgaaagtttaatattatatgtttcagtgtaacataatcttactgggagtgtgttgaatacaccagaactttttgaattgtgtgctgaatgatgtacatagtctagaagaaaaaagcccaagtcttgtgcacatttaaatcgtgtacataagtatttccgtatttcagtaaagtagataaagcactcgttaaatagcattgtttacatcgaccaaatattgcctgtttcctttaattcaaatgcattaggttcccgcctccctctccttccccgccatgttgctgttttaaggcttcatatgtattaacatttctctgatcaaaattgtggctgttttccttatgaaccataatataatcatttgtgtgatgtacattgtgccatttttgatgactaaatgtctatatttctgccattcctgtaagagagggagttttttactgatagtagcaaatgttcacttcagtcaaacttgggtgttcagtggtaaaccatatagtatttagactggtaaaaatagtttgcacacaggaatagcctctgatttttagctctcttgtaatccaagtatcattgttcatggaattctctaggtcatttttattgtgttgttctaacaagacagattattgctacaacaatagttacaagatatttctaaaatatcctttgatttttactctaagtatggtagagtaagaggctaaacaagaagctgtttccttgaagacattgctttcagtcaccatacatgtctaaataatttagcttatcattcattctatgtaggaatgagataagaaaggatatgatggcaggaaaagaaatgctattcattttttatactttagttttattttcttaggatctatatcctatatatatatattttttaaagcactaatttattgcagtctttattttagaaaaatgtgaagcatttttttctcccctaaaatgaatatatttagatgacaagtctttagtgctggtagaggaactaattgattttgtactatagtaggaaagtgtttatatgtttcaccagaaataaaatatgtagggtttgtatgtaatcttctgtgtttatcctatgttgatttaccttaaatttgcaacatacatatccacataaatattcatgactttcttatatttcattaaaatgttttatggcttcttaaaatcatcactgtgcttctaaatatttttacgtaaaatcattgtataatgctatactgtgatatacatgaaagtttatcttgaacagtgctctttaacaatattaaatttaaatttatcttggttttgctatgcttatgggtaattcatagaaaacagaaaaaatactgttcccaaaaggcagttatatatttcagtttaatatcacctataagtatgagaaaggtttccatgtctcctacccctcactgcacttaggaaaattcttatttatgaataaagtaagataagtaaatctaattgcctagtcgtttttttaacacatatacatgcaatgtatctggatgaatagaaggctgaattgaagctttctttatatttaagaggtaaaaagaaatattaatacttttaaaatatactaacaaccaaaaagtgttcagaattttgctatantaataatttgtattaaaatagtacctagaaaaattcagtctatggaataggtaaaattttaaaattttaatttgctctcagagttctgtctgataaaataattgaactataattggcatgatgaatattcccaggttttacttcagtatataaatttaactctcagccacatgggctttccagacttttcaatacatatgatgttgcaggaattgcaatatttgcaaacatgtgccacaacagtgttcttggtgatgtttctaaaacagtttttattctattaatgttaaattttctaacataaacatttaattgattaatgtaaaattttaggaaggaacatctttaattttcaatatgagatggttgcaacctttaaagtagtacatatttgattttttttaaaaggcaatatttttttttctaggaaaactattcattatggttatttaactgcatatgttttttaaatttttccctcttggaacaacatgtactggggcctatcaaagggtggagggtgggaggagggagaggaacaggaaaaataactaatgggtactaggcttaatacctgggtgatgaaataatctgtataataaatccccatgacacaaaagtttacctgtgtaacaaacctgcatatgtacccctaaacttaaattcttccctctttttgtcttgggcacaagtttttgggatatggaaaagtttattgtatcccttttgaattttcttctaagatgaactttttaaataaaagatattactgcttttatattta

SEQ ID NO: 458964 - DNA, 3502 bp, Homo sapiens
ggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458965 - DNA, 2241 bp, Homo sapiens
ggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgcccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458966 - DNA, 614 bp, Homo sapiens
gtcgtgaggaagccgtggttctggctaggctcccctggtccccgctgtctggacatgagagcctagccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458967 - DNA, 324 bp, Homo sapiens
acaggttagagagccaagggccagatggttttgccgagtcgcccctgctagtgtgggggagcagcactttatgcttgtgaagccctgactggaaccacttggcctggagtctgggaggggcctcccttcccagcccttgtccttcctcccccgcccacagactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458968 - DNA, 621 bp, Homo sapiens
gtagcttgtgtgctttactatgatgaaaagaatcaaatcaaagcactaaggggcgtaagattgcaggcagggttggaattacttatccgctctccaatggttagggagcaagaggggagggcaagggaactatctattccctcggaagggatcttacaagcggtaggcgaacaaacctcccatcgtgtcctctctagattccaccagactcagttcccctgagatatcccccgttctcagatttgagttcctgcctcttcctcttagcctaccagcccaagttatcccctgatacaggcccctagccctccaggcttccacatctcccagaagcgaggaagttggacctgaggctttcaaagtcgcaggttcaattcagatctctttaagagcccccagggtcctgctaccacaggttggtgtcttgatactggttacataacaatcagtccccaaagctctgacatcacccactgaagattctcaccagcctggacagccaaaggggtctgtgtgtggccggggaggatggcgggggagtgagccccatggaacagccaggaactggtaaggggaggtagggcacagatcccagtaaatgatggtaaatggtggtgaccc

SEQ ID NO: 458969 - DNA, 3463 bp, Homo sapiens
ggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458970 - DNA, 3030 bp, Homo sapiens
ggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458971 - DNA, 4040 bp, Homo sapiens
ggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtgaaaaaaaaaaaaaaataacatacaaaacaaattttgggggaaagaatttaaggccatacagaaaaaggtattagaaaccacatttagtgaattgggcgacgacgaggcccaatggaggtacattataaaattaggagacaataaggaggtaacacaaagagagaatattgggcaataaaaataatgaggtatgagattcacacgagtaaaaaagaactctccgggtgaaaccagaggtgtttctgagacagactccagaaggagtgttcgagaagcaatacctggagactaataacgaggggtcacaggggagaccagaacaaacaaaaataacgcccgccctgggggagcaagacaaaaagcaagcaagaacacaaaaacgagcagaacaaaataaacaaagacaaaacagcgaaaaaaaagaaagaaaaaaatatagaatcaacataaaaacacaaaaaacagctaactcacaaacataattataataataaaaaacataaataaaagaataatataaactacaaaaaagaacagc

SEQ ID NO: 458972 - DNA, 3740 bp, Homo sapiens
  misc_feature (3732)..(3732): n is a, c, g, or t
ggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtgaaaaaaaaaaaaaaaaaaaaaaactccggagggaatttatattgttggggggcggagaaaaagagagggtatgagaaggggcaaggggctcattagttggttccctggaccaaggttttttggtacaagggggaaaatttggccgggtccccccaattaggggaagtcgatattaaatttcgagatataagccacaggttaaccttgggttatatggaattcggaaaacnctgaaaag

SEQ ID NO: 458973 - DNA, 2423 bp, Homo sapiens
tcctgcctcttcctgccagtcggtaccctgtctcagtacacatcgactcactcctctggctcctcccatcctcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458974 - DNA, 3376 bp, Homo sapiens
ggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458975 - DNA, 3347 bp, Homo sapiens
ggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggattgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458976 - DNA, 2611 bp, Homo sapiens
ggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgta

SEQ ID NO: 458977 - DNA, 1616 bp, Homo sapiens
ggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggtagaccctggggtgaggggagcagcctattgccaggcagggccatggggctctgagactggcactcagggccccaggattgcccgagacccttcccagctcacttcacaggcagacctgcactgcgctgtttccctctatagaaaccagtctttggtcagcacccgcgtgcagcctgctcttaactaagattctctacccggcctccctctaaacctgttctgtttgtggtttataccccatctactttcaggaagggtttgactgtgcttacaacacagaaacactacttgggaggctgagacaggagaatcacttgaacccaggagggagaggttgcagtgagctgagatcacaccactgcactccatcccaggtggcagagcaagactctgtctca

SEQ ID NO: 458978 - DNA, 848 bp, Homo sapiens
ggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgttactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458979 - DNA, 1754 bp, Homo sapiens
aactgttctgaaaagtttatttttaaaaaacttagagagagagagagagagaatcaaaataacctatgaagatttatagaaaacacaccaggtaaggaagggttctttcaaagcaaccacaggaacagttacgataacttaaaaagaaatgctttccacactgaactgacagcgctgcagaccacgcctgagtggggacggcagccccaagcccaggggcaagcgcccacaggctggacccaggccaggcacacctggggagtctcttactgctgaaaacctcagccatctcacttcatgtacttatcctgctggtcagccaggattttggcggaggacttggcatcatagaaaagttcactgatctcttcgacatgctctttctcaatgctgtccttcccgttgattttagcaagcaagttggccggggtcagcagctgcactgagtacctcagtgtggtcttggtgccaatctcccccaggtggttcagtgcctcctcactgatgttgattccttccgtctgggcacggattttaatgatctgtttcatttcctgtggagtatacagcatggtccggattatcatcactcggtccagaaggtcaagagggatgccgtgaggggatgtgatgtcctcagtgcctctgatgacacagttgcctcggttggatgcaaagatgacgatgggagcgatagaagactccagggcgcggtgcaggtaggtgaagcactcaatgtccagcatgtggacctcatcaacaaacagcacacccgggaccagctcagcaatgccctggtcgatgtacttgttcaccaccttaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458980 - DNA, 3791 bp, Homo sapiens
gtagcttgtgtgctttactatgatgaaaagaatcaaatcaaagcactaaggggcgtaagattgcaggcagggttggaattacttatccgctctccaatggttagggagcaagaggggagggcaagggaactatctattccctcggaagggatcttacaagcggtaggcgaacaaacctcccatcgtgtcctctctagattccaccagactcagttcccctgagatatcccccgttctcagatttgagttcctgcctcttcctcttagcctaccagcccaagttatcccctgatacaggcccctagccctccaggcttccacatctcccagaagcgaggaagttggacctgaggctttcaaagtcgcaggttcaattcagatctctttaagagcccccagggtcctgctaccacaggttggtgtcttgatactggttacataacaatcagtccccaaagctctgacatcacccactgaagattctcaccagcctggacagccaaaggggtctgtgtgtggccggggaggatggcgggggagtgagccccatggaacagccaggaactgcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458981 - DNA, 3657 bp, Homo sapiens
atttcttccagtctcagcctttctaaaaaaaaaaatgtggccgggcacggtggctcgcgcttgtactcccaaagtactaggattacaggcgtgagccaccacgcctggcctttcagagaacttttcaaaggagctttttctgcgtccagtgaaggatccctgctctcaactgagactgccccttgcctttctgggctgttctaagcttagtgtgaaactcagatatgcgtggctgagccctggcccgcaagtcgccagcctctccacggctttgttcttcctcagcctgctcggactttcagagaatggcgcgtctgtgcttctccgtcccaccgtctaccagcctgtgtggtccccagcttttgccagccgtccatttcaattccctcacccaagcggctggttgaaagggcagggctggccctagcagcagtaggaagcggccagctctcttcagtgtggagatttagccaagtgctggaggattctgagatgggatttcagcgccccagcgtgaccttctgcttcccctccgaactgaatggtgacctaggcttgcacagttttcactaacaagtcagcagcttgaaagttgacctctcaaactctaggggaaaagtgtgtgaggaagtgctgatttgggtcagtttgagcctgctggttgcattcccagttgagaaagtccatacgatttgccggccaccccgggaaactaagacgatagaaaaccacctgtcagttccccgctgctggagaggaagccagagatggagcgaaggagtacagagagccctttgttgtgtccggagcagtgatgactgtgtcttgacgcctctcttctggctcttgctctcatgtaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458982 - DNA, 3544 bp, Homo sapiens
ggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctctcggacgtcacccgtcgccggtggcgctccgcgtgaaagcggtcggcgtggtgggagaagagatacggggcaacagaggccggcggcggccg

SEQ ID NO: 458983 - DNA, 2614 bp, Homo sapiens
cttctttgggttgacagactgggttttactcttcctgaatcatcacaatgatccgtgcaaggccaaggctgttgtcttctgtttcaagtgcgttttcctgtcctgtcctctgtcctgtggcagtggacagctgtggctcttgccagattgtgtctgctcctaggactgtgggagccggtggtggtagcggccttgagcttgacccatccctcctgcttccctgttcctgagcgagcaccttggagtatccttggagtgtccttggaggctctgctctcgggggcagcctgggccaagagagcgcctgatgctcaccccgtcctcacaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458984 - DNA, 2249 bp, Homo sapiens
attcttgtcacccagagcatggaagtgcagatggcctggtgagcgactctcggaaagcatctacctcacagatttaacgcgagcatcatatctcccctgtcgcacttaccgagcctccggaagatgcagaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458985 - DNA, 3257 bp, Homo sapiens
  misc_feature (3249)..(3249): n is a, c, g, or t
ggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctgggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagtgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactcccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtgaaaaaaaaaaaaaaaaaaaaaaactccggagggaatttatattgttggggggcggagaaaaagagagggtatgagaaggggcaaggggctcattagttggttccctggaccaaggttttttggtacaagggggaaaatttggccgggtccccccaattaggggaagtcgatattaaatttcgagatataagccacaggttaaccttgggttatatggaattcggaaaacnctgaaaag

SEQ ID NO: 458986 - DNA, 1335 bp, Homo sapiens
ggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggccgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtg

SEQ ID NO: 458987 - DNA, 6104 bp, Homo sapiens
aagccacgcagggccacgtctgcggttctgaggactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatcattttaagcatatttctcactttttttttgctaatgacttattgctgtttatatttattttagactatggaaatgatgttagacaaaaatcaaatttagcgattttctgagttcaaaataggttataaagcagcagagacaacacacaacatcaacaatgcatttggcccaggaactgctaatgaacatacagtgccgtgatggctcaagaagttttgcaaaggagactagagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaagtgtcattttctctattctatgcaacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcattgtttggtggtttgctgccagtctgatccactacagctttctgaatccaggtgaaaccattacatctgataagtatgctcagcaaatcaatgagatgcaccaaaaactgcaatgcctgcagccggcattggccaccagaaagggcccaattcttttcacgacaacactgggccgcacgttgcacaaccaacgcttcgaaaattgaactaattgggctatgaagttttgcctcatctgccatattcacctgacctcttgccaacaaactaccacttctttaggcatctcagcaacgttttgcagggaaattgcttccacaactagcaggacacagaaaatgctttccaagagttcgtcaaatttggaagcatggatttttatgctacaggagtaaacaaacttatttctcattggcaaaaatgtgttgattgtaatggttcctattttaattaataaagatttgtgtgaacctagttataatgacttaaaattcatggtcccaaacagcaattacttttgcaccaaactaaaaatataagttaaaatggaagagtctaggagcaaaccaagaaaagatcacctacttcatcatctctggtcaaaaacaaaccaaaaaacttaacagctatcacttaagtttgcttcctagcaattatttagcttccagtctagattacaggatatataaaactttctttctttctttcttaactatgacactggcaccaatgagagtcctgtgactgactttcacatttccaccattactcaattactggtaccataccacctctaatcccctaaatcaaactgcaattcaacaataaagggcgtacagagatgactttgtcctgaaggaaaatgaatatccttgtaccctctatatagctaacttccaaatgtaagagaactatggggtaaccttttgtttctattcctatcaagatgagcctttaagagagggacttttattaagctcttgaccaagaagaatacacttgattcagagtttctgatgctcttaatcagaactatatgtattgtctcaatattaaataaagtcaaatgtttccatacaaatgat

SEQ ID NO: 458988 - DNA, 6059 bp, Homo sapiens
aagccacgcagggccacgtctgcggttctgaggactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaagagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatcattttaagcatatttctcactttttttttgctaatgacttattgctgtttatatttattttagactatggaaatgatgttagacaaaaatcaaatttagcgattttctgagttcaaaataggttataaagcagcagagacaacacacaacatcaacaatgcatttggcccaggaactgctaatgaacatacagtgccgtgatggctcaagaagttttgcaaaggagactagagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaagtgtcattttctctattctatgcaacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcattgtttggtggtttgctgccagtctgatccactacagctttctgaatccaggtgaaaccattacatctgataagtatgctcagcaaatcaatgagatgcaccaaaaactgcaatgcctgcagccggcattggccaccagaaagggcccaattcttttcacgacaacactgggccgcacgttgcacaaccaacgcttcgaaaattgaactaattgggctatgaagttttgcctcatctgccatattcacctgacctcttgccaacaaactaccacttctttaggcatctcagcaacgttttgcagggaaattgcttccacaactagcaggacacagaaaatgctttccaagagttcgtcaaatttggaagcatggatttttatgctacaggagtaaacaaacttatttctcattggcaaaaatgtgttgattgtaatggttcctattttaattaataaagatttgtgtgaacctagttataatgacttaaaattcatggtcccaaacagcaattacttttgcaccaaactaaaaatataagttaaaatggaagagtctaggagcaaaccaagaaaagatcacctacttcatcatctctggtcaaaaacaaaccaaaaaacttaacagctatcacttaagtttgcttcctagcaattatttagcttccagtctagattacaggatatataaaactttctttctttctttcttaactatgacactggcaccaatgagagtcctgtgactgactttcacatttccaccattactcaattactggtaccataccacctctaatcccctaaatcaaactgcaattcaacaataaagggcgtacagagatgactttgtcctgaaggaaaatgaatatccttgtaccctctatatagctaacttccaaatgtaagagaactatggggtaaccttttgtttctattcctatcaagatgagcctttaagagagggacttttattaagctcttgaccaagaagaatacacttgattcagagtttctgatgctcttaatcagaactatatgtattgtctcaatattaaataaagtcaaatgtttccatacaaatgat

SEQ ID NO: 458989 - DNA, 4515 bp, Homo sapiens
aagccacgcagggccacgtctgcggttctgaggactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatcaaaaaaaaaaaaaaaaaaaaacaaaaacacacaccaaaaaataaggggggcgcgcaccaaacgcccccgaggggggccccaactgccgcaccccgcttttcggcaacgcggcgccccaagggggccaaca

SEQ ID NO: 458990 - DNA, 3237 bp, Homo sapiens
aagccacgcagggccacgtctgcggttctgaggactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctttgctcttttccgaagaagttttgctagtcgtaccacgtaaggtttaaattctcgttgatgtataccctgccttctgacttccaaacctgaatcatctgaggcttctggaataaaggcccatcg

SEQ ID NO: 458991 - DNA, 5898 bp, Homo sapiens
aagccacgcagggccacgtctgcggttctgaggactgggtttgggtgcagacgttgttgcttgggcgcttctccgctgcgtgtaggtgaagggggcttcctgaccgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatcattttaagcatatttctcactttttttttgctaatgacttattgctgtttatatttattttagactatggaaatgatgttagacaaaaatcaaatttagcgattttctgagttcaaaataggttataaagcagcagagacaacacacaacatcaacaatgcatttggcccaggaactgctaatgaacatacagtgccgtgatggctcaagaagttttgcaaaggagactagagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaagtgtcattttctctattctatgcaacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcattgtttggtggtttgctgccagtctgatccactacagctttctgaatccaggtgaaaccattacatctgataagtatgctcagcaaatcaatgagatgcaccaaaaactgcaatgcctgcagccggcattggccaccagaaagggcccaattcttttcacgacaacactgggccgcacgttgcacaaccaacgcttcgaaaattgaactaattgggctatgaagttttgcctcatctgccatattcacctgacctcttgccaacaaactaccacttctttaggcatctcagcaacgttttgcagggaaattgcttccacaactagcaggacacagaaaatgctttccaagagttcgtcaaatttggaagcatggatttttatgctacaggagtaaacaaacttatttctcattggcaaaaatgtgttgattgtaatggttcctattttaattaataaagatttgtgtgaacctagttataatgacttaaaattcatggtcccaaacagcaattacttttgcaccaaactaaaaatataagttaaaatggaagagtctaggagcaaaccaagaaaagatcacctacttcatcatctctggtcaaaaacaaaccaaaaaacttaacagctatcacttaagtttgcttcctagcaattatttagcttccagtctagattacaggatatataaaactttctttctttctttcttaactatgacactggcaccaatgagagtcctgtgactgactttcacatttccaccattactcaattactggtaccataccacctctaatcccctaaatcaaactgcaattcaacaataaagggcgtacagagatgactttgtcctgaaggaaaatgaatatccttgtaccctctatatagctaacttccaaatgtaagagaactatggggtaaccttttgtttctattcctatcaagatgagcctttaagagagggacttttattaagctcttgaccaagaagaatacacttgattcagagtttctgatgctcttaatcagaactatatgtattgtctcaatattaaataaagtcaaatgtttccatacaaatgat

SEQ ID NO: 458992 - DNA, 6622 bp, Homo sapiens
aagccacgcagggccacgtctgcggttctgaggactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagggtcaagacttgtggtctggatttttattatttggcctcttcacatactccttaaagtgtgtgcaaagccagggcaaagtacagtgagtgcgctgaatagggaatcaggaggagacatttggcagctttcctgcagaagcttaagccatctcagagtctaatgaatatccatgatggatgaggagatggcaacagaggcattagtacttacttactgttaggccaattgtggattaaagttttattgaattttttcagttgtggaatgatagctatttttataatctgaattgattaaaaacttaccttatttagaagaatttggtctgttttccgtttatttaagggctttggaatttgttactgaaagatgaaaaaaggttttcattagaatttgttagtgaaacaaaatcaagaatcacccctctcttccccagagttccaagtaacatggtcttgcccatgttagacacatgctatgtctttctcatctaatctcttttaatgtaatttgcaggaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatcattttaagcatatttctcactttttttttgctaatgacttattgctgtttatatttattttagactatggaaatgatgttagacaaaaatcaaatttagcgattttctgagttcaaaataggttataaagcagcagagacaacacacaacatcaacaatgcatttggcccaggaactgctaatgaacatacagtgccgtgatggctcaagaagttttgcaaaggagactagagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaagtgtcattttctctattctatgcaacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcattgtttggtggtttgctgccagtctgatccactacagctttctgaatccaggtgaaaccattacatctgataagtatgctcagcaaatcaatgagatgcaccaaaaactgcaatgcctgcagccggcattggccaccagaaagggcccaattcttttcacgacaacactgggccgcacgttgcacaaccaacgcttcgaaaattgaactaattgggctatgaagttttgcctcatctgccatattcacctgacctcttgccaacaaactaccacttctttaggcatctcagcaacgttttgcagggaaattgcttccacaactagcaggacacagaaaatgctttccaagagttcgtcaaatttggaagcatggatttttatgctacaggagtaaacaaacttatttctcattggcaaaaatgtgttgattgtaatggttcctattttaattaataaagatttgtgtgaacctagttataatgacttaaaattcatggtcccaaacagcaattacttttgcaccaaactaaaaatataagttaaaatggaagagtctaggagcaaaccaagaaaagatcacctacttcatcatctctggtcaaaaacaaaccaaaaaacttaacagctatcacttaagtttgcttcctagcaattatttagcttccagtctagattacaggatatataaaactttctttctttctttcttaactatgacactggcaccaatgagagtcctgtgactgactttcacatttccaccattactcaattactggtaccataccacctctaatcccctaaatcaaactgcaattcaacaataaagggcgtacagagatgactttgtcctgaaggaaaatgaatatccttgtaccctctatatagctaacttccaaatgtaagagaactatggggtaaccttttgtttctattcctatcaagatgagcctttaagagagggacttttattaagctcttgaccaagaagaatacacttgattcagagtttctgatgctcttaatcagaactatatgtattgtctcaatattaaataaagtcaaatgtttccatacaaatgat

SEQ ID NO: 458993 - DNA, 5044 bp, Homo sapiens
tatctctgggatactaggtatgcaagaaacatttgacatctgagtaattgctgtatttctttaaatgcatgtgttataggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatcattttaagcatatttctcactttttttttgctaatgacttattgctgtttatatttattttagactatggaaatgatgttagacaaaaatcaaatttagcgattttctgagttcaaaataggttataaagcagcagagacaacacacaacatcaacaatgcatttggcccaggaactgctaatgaacatacagtgccgtgatggctcaagaagttttgcaaaggagactagagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaagtgtcattttctctattctatgcaacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcattgtttggtggtttgctgccagtctgatccactacagctttctgaatccaggtgaaaccattacatctgataagtatgctcagcaaatcaatgagatgcaccaaaaactgcaatgcctgcagccggcattggccaccagaaagggcccaattcttttcacgacaacactgggccgcacgttgcacaaccaacgcttcgaaaattgaactaattgggctatgaagttttgcctcatctgccatattcacctgacctcttgccaacaaactaccacttctttaggcatctcagcaacgttttgcagggaaattgcttccacaactagcaggacacagaaaatgctttccaagagttcgtcaaatttggaagcatggatttttatgctacaggagtaaacaaacttatttctcattggcaaaaatgtgttgattgtaatggttcctattttaattaataaagatttgtgtgaacctagttataatgacttaaaattcatggtcccaaacagcaattacttttgcaccaaactaaaaatataagttaaaatggaagagtctaggagcaaaccaagaaaagatcacctacttcatcatctctggtcaaaaacaaaccaaaaaacttaacagctatcacttaagtttgcttcctagcaattatttagcttccagtctagattacaggatatataaaactttctttctttctttcttaactatgacactggcaccaatgagagtcctgtgactgactttcacatttccaccattactcaattactggtaccataccacctctaatcccctaaatcaaactgcaattcaacaataaagggcgtacagagatgactttgtcctgaaggaaaatgaatatccttgtaccctctatatagctaacttccaaatgtaagagaactatggggtaaccttttgtttctattcctatcaagatgagcctttaagagagggacttttattaagctcttgaccaagaagaatacacttgattcagagtttctgatgctcttaatcagaactatatgtattgtctcaatattaaataaagtcaaatgtttccatacaaatgat

SEQ ID NO: 458994 - DNA, 5106 bp, Homo sapiens
actcttgtgacatgaaaacaaccagctttgtagttcatttctaagtcaactgatagcattctggactcttgatttgtttttcaaaatatttcctttaaatgacagccttactctgtgcctgtttccctgacaggggtcaagacttgtggtctggatttttattatttggcctcttcacatactccttaaagtgtgtgcaaagccagggcaaagtacagtgagtgcgctgaatagggaatcaggaggagacatttggcagctttcctgcagaagcttaagccatctcagagtctaatgaatatccatgatggatgaggagatggcaacagaggcattagtacttacttactgttaggccaattgtggattaaagttttattgaattttttcagttgtggaatgatagctatttttataatctgaattgattaaaaacttaccttatttagaagaatttggtctgttttccgtttatttaagggctttggaatttgttactgaaagatgaaaaaaggttttcattagaatttgttagtgaaacaaaatcaagaatcacccctctcttccccagagttccaagtaacatggtcttgcccatgttagacacatgctatgtctttctcatctaatctcttttaatgtaatttgcaggaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatcattttaagcatatttctcactttttttttgctaatgacttattgctgtttatatttattttagactatggaaatgatgttagacaaaaatcaaatttagcgattttctgagttcaaaataggttataaagcagcagagacaacacacaacatcaacaatgcatttggcccaggaactgctaatgaacatacagtgccgtgatggctcaagaagttttgcaaaggagactagagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaagtgtcattttctctattctatgcaacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcattgtttggtggtttgctgccagtctgatccactacagctttctgaatccaggtgaaaccattacatctgataagtatgctcagcaaatcaatgagatgcaccaaaaactgcaatgcctgcagccggcattggccaccagaaagggcccaattcttttcacgacaacactgggccgcacgttgcacaaccaacgcttcgaaaattgaactaattgggctatgaagttttgcctcatctgccatattcacctgacctcttgccaacaaactaccacttctttaggcatctcagcaacgttttgcagggaaattgcttccacaactagcaggacacagaaaatgctttccaagagttcgtcaaatttggaagcatggatttttatgctacaggagtaaacaaacttatttctcattggcaaaaatgtgttgattgtaatggttcctattttaattaataaagatttgtgtgaacctagttataatgacttaaaattcatggtcccaaacagcaattacttttgcaccaaactaaaaatataagttaaaatggaagagtctaggagcaaaccaagaaaagatcacctacttcatcatctctggtcaaaaacaaaccaaaaaacttaacagctatcacttaagtttgcttcctagcaattatttagcttccagtctagattacaggatatataaaactttctttctttctttcttaactatgacactggcaccaatgagagtcctgtgactgactttcacatttccaccattactcaattactggtaccataccacctctaatcccctaaatcaaactgcaattcaacaataaagggcgtacagagatgactttgtcctgaaggaaaatgaatatccttgtaccctctatatagctaacttccaaatgtaagagaactatggggtaaccttttgtttctattcctatcaagatgagcctttaagagagggacttttattaagctcttgaccaagaagaatacacttgattcagagtttctgatgctcttaatcagaactatatgtattgtctcaatattaaataaagtcaaatgtttccatacaaatgat

SEQ ID NO: 458995 - DNA, 608 bp, Homo sapiens
ctgcactacatggtgtattgtcgaaacacgggtggccgatatggaaaggcaactatagaaggttactaccagaaactctctaaggcttttgtggaactcaccaaacaggtgaaaagtttattgaacatggttaaagttaaacaaatgaataaagtaacatggtctactgaacaaattatcttgtttgtcatgcctcctctttccttttccaaagatgctgcatatctccttttttgtttttctctagggctacacaaggttctggtctatgtatcctgctaacttacattggcgtttacttggcaaattatgtagtacattctgagatactttggggaagcaaacatggtgggggtcttgacgatggtatcataagtattcattcagatgaatttgatcttagttaatgtaggtgctgttggcttaatacctgaggcatgtactattgagattttcttctaggtatattggcttgttaaatgtagagagatttgagaagtataattcgtttgatcaacaaatattgagtatatgtccttaccaggcacaattaactaaaagcccttgctctcatagaacttataatttggggtgaggatagctgggag

SEQ ID NO: 458996 - DNA, 425 bp, Homo sapiens
attattagtttaattgattatgtgtgtcatgaggatttaatgaggtaatatatatacataaaatacctaatccagggtccagtattaatatttggtgtttattgttgaagctgctcagccatcactgtctttggttgaagggaaacagcttttgagttctgttctcaactcagcctcatgagtatgcacagattgcttattgtttgtttttcttttaaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggtgatgataagagttactggt

SEQ ID NO: 458997 - DNA, 561 bp, Homo sapiens
aagccacgcagggccacgtctgcggttctgaggactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccagcccaaccgtggagaaactttcacaaacttgtaaaaatggtggggatggtccttggaagtgaa

SEQ ID NO: 458998 - DNA, 4386 bp, Homo sapiens
aagccacgcagggccacgtctgcggttctgaggactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatca

SEQ ID NO: 458999 - DNA, 4332 bp, Homo sapiens
aagccacgcagggccacgtctgcggttctgaggactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatca

SEQ ID NO: 459000 - DNA, 2717 bp, Homo sapiens
aagccacgcagggccacgtctgcggttctgaggactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacataca

SEQ ID NO: 459001 - DNA, 6315 bp, Homo sapiens
aagccacgcagggccacgtctgcggttctgaggactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaacttatttagaagaatttggtctgttttccgtttatttaagggctttggaatttgttactgaaagatgaaaaaaggttttcattagaatttgttagtgaaacaaaatcaagaatcacccctctcttccccagagttccaagtaacatggtcttgcccatgttagacacatgctatgtctttctcatctaatctcttttaatgtaatttgcaggaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatcattttaagcatatttctcactttttttttgctaatgacttattgctgtttatatttattttagactatggaaatgatgttagacaaaaatcaaatttagcgattttctgagttcaaaataggttataaagcagcagagacaacacacaacatcaacaatgcatttggcccaggaactgctaatgaacatacagtgccgtgatggctcaagaagttttgcaaaggagactagagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaagtgtcattttctctattctatgcaacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcattgtttggtggtttgctgccagtctgatccactacagctttctgaatccaggtgaaaccattacatctgataagtatgctcagcaaatcaatgagatgcaccaaaaactgcaatgcctgcagccggcattggccaccagaaagggcccaattcttttcacgacaacactgggccgcacgttgcacaaccaacgcttcgaaaattgaactaattgggctatgaagttttgcctcatctgccatattcacctgacctcttgccaacaaactaccacttctttaggcatctcagcaacgttttgcagggaaattgcttccacaactagcaggacacagaaaatgctttccaagagttcgtcaaatttggaagcatggatttttatgctacaggagtaaacaaacttatttctcattggcaaaaatgtgttgattgtaatggttcctattttaattaataaagatttgtgtgaacctagttataatgacttaaaattcatggtcccaaacagcaattacttttgcaccaaactaaaaatataagttaaaatggaagagtctaggagcaaaccaagaaaagatcacctacttcatcatctctggtcaaaaacaaaccaaaaaacttaacagctatcacttaagtttgcttcctagcaattatttagcttccagtctagattacaggatatataaaactttctttctttctttcttaactatgacactggcaccaatgagagtcctgtgactgactttcacatttccaccattactcaattactggtaccataccacctctaatcccctaaatcaaactgcaattcaacaataaagggcgtacagagatgactttgtcctgaaggaaaatgaatatccttgtaccctctatatagctaacttccaaatgtaagagaactatggggtaaccttttgtttctattcctatcaagatgagcctttaagagagggacttttattaagctcttgaccaagaagaatacacttgattcagagtttctgatgctcttaatcagaactatatgtattgtctcaatattaaataaagtcaaatgtttccatacaaatgat

SEQ ID NO: 459002 - DNA, 5170 bp, Homo sapiens
tcttaaaattggtccaaaagtattattccagtaactactccttttgtttttctttttctttttttgagacaaggtcttgctatgttgcccaggctggagtgcattggctgttcacaggcattatcacagcacactgcagcctcaaactcctagcttcaagtaatcatcccatctcagcctctcctgagtagctgggactgtaggtgtatgccaccacacctggcagttgtatacccacattttgacctgtcacaggaggccaggtgtggaatttttcacttgtgattattttggcactcagcatgtttcagattcaggttgttcaacctgtactgtgattggttttctaagaaaaaacatccatttccaagatttgcttgtgttaagtggtttcttccatttgtttccccatttgcaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatcattttaagcatatttctcactttttttttgctaatgacttattgctgtttatatttattttagactatggaaatgatgttagacaaaaatcaaatttagcgattttctgagttcaaaataggttataaagcagcagagacaacacacaacatcaacaatgcatttggcccaggaactgctaatgaacatacagtgccgtgatggctcaagaagttttgcaaaggagactagagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaagtgtcattttctctattctatgcaacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcattgtttggtggtttgctgccagtctgatccactacagctttctgaatccaggtgaaaccattacatctgataagtatgctcagcaaatcaatgagatgcaccaaaaactgcaatgcctgcagccggcattggccaccagaaagggcccaattcttttcacgacaacactgggccgcacgttgcacaaccaacgcttcgaaaattgaactaattgggctatgaagttttgcctcatctgccatattcacctgacctcttgccaacaaactaccacttctttaggcatctcagcaacgttttgcagggaaattgcttccacaactagcaggacacagaaaatgctttccaagagttcgtcaaatttggaagcatggatttttatgctacaggagtaaacaaacttatttctcattggcaaaaatgtgttgattgtaatggttcctattttaattaataaagatttgtgtgaacctagttataatgacttaaaattcatggtcccaaacagcaattacttttgcaccaaactaaaaatataagttaaaatggaagagtctaggagcaaaccaagaaaagatcacctacttcatcatctctggtcaaaaacaaaccaaaaaacttaacagctatcacttaagtttgcttcctagcaattatttagcttccagtctagattacaggatatataaaactttctttctttctttcttaactatgacactggcaccaatgagagtcctgtgactgactttcacatttccaccattactcaattactggtaccataccacctctaatcccctaaatcaaactgcaattcaacaataaagggcgtacagagatgactttgtcctgaaggaaaatgaatatccttgtaccctctatatagctaacttccaaatgtaagagaactatggggtaaccttttgtttctattcctatcaagatgagcctttaagagagggacttttattaagctcttgaccaagaagaatacacttgattcagagtttctgatgctcttaatcagaactatatgtattgtctcaatattaaataaagtcaaatgtttccatacaaatgat

SEQ ID NO: 459003 - DNA, 569 bp, Homo sapiens
ccactgcacccagcctcagggcactcttacttgaaaaattgtttatagttattcaaactttatatagatagaggacattgtaaagccttttcctggaaaaagtaaaccttgtgagctaagatggtagctagaacatttatgattattttcttgtacaggtcctttgacttgattcattcacctcacggagagttaaaggctgtcttcctgctgcagaacaacctggtggaattgtattcactgaatccatccttgcctactcctcagcctgtcaggacaagcagaatcactattgggggtcatcgcagtgatgtgcggactttgtcattcagctcagacaatattgctgttctttcagctgcagctgattccattaaaatatggaacaggttcgtgaaatgatgttttatatagctgtagttagtagtatttcttttaattttttttggtactcttaagggttagttattaactccttaaggccctaaatacaattatctttagtgcatttgggccattagcctgtggagcttagagaagaaaaagttgccttttaaaatgtggtgcaa

SEQ ID NO: 459004 - DNA, 3890 bp, Homo sapiens
cgagacgggcgtgttaaaggccggttgctagggctgggggaactcagattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatctgggacttaaggaaaggagagaagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggacacagatattattgtatgggatgtgatcaatgaaagtggtctgtaccgtctaaaggggcacaaggatgccatcacacaagcattgtttctacgagaaaagaacctgctagttactagtgggaaagataccatggtgaaatggtgggaccttgatactcagcactgctttaaaacaatggttggccaccggactgaggtatgggggttggttctgttgtcagaagaaaagcgactcatcactggggcctcagacagtgaactgagggtatgggacatagcttatctgcaagagattgaagacccggaagaaccagaccccaagaaaatcaaaggatcttctcctggaatacaagatactcttgaggcagaggatggtgcctttgagacggatgaagcccctgaggatcgaatcctttcatgcagaaaagctggttccataatgcgggaaggaagagacagagttgtaaaccttgcagtcgacaagacaggcaggattcttgcttgccatggaactgactctgtgctagaattgttttgtatcctttccaaaaaggaaattcagaagaaaatggataagaagatgaagaaagctagaaagaaagcaaaattacattctagcaaaggagaggaggaagatcctgaggttaatgttgaaatgagtctgcaagatgaaatccagcgggtgactaatataaaaacttctgccaaaatcaagtcctttgacttgattcattcacctcacggagagttaaaggctgtcttcctgctgcagaacaacctggtggaattgtattcactgaatccatccttgcctactcctcagcctgtcaggacaagcagaatcactattgggggtcatcgcagtgatgtgcggactttgtcattcagctcagacaatattgctgttctttcagctgcagctgattccattaaaatatggaacaggtctacactgcagtgtattcgcacaatgacctgtgaatatgcactttgctcattctttgtacctggtgatagacaggtagtcataggaacaaagacagggaagctgcagctttatgacttggcttcagggaatctgctggagacaatagatgcacatgatggagctttgtggtccatgtccctctctccagatcagcgtggctttgtgacaggtggtgcagataaatctgtcaaattctgggattttgagttagtgaaagatgaaaatagtacccaaaagagactttctgtgaagcaaacccgaactttgcaactagatgaagatgttctgtgtgtcagttactctcccaatcaaaagctattggctgtgtctttgctggactgtactgtgaaaattttctacgttgatactttaaagttttttctgtcactgtatggacacaaactgcctgttatatgcatggacatctctcatgatggagcactcatagcaactggctccgctgataggaatgtgaaaatctggggtttggactttggggactgccacaagtctctctttgcacatgatgacagtgtgatgtacctacagtttgtacccaagtctcacctcttcttcactgccggaaaagatcataagattaaacagtgggatgcagacaaatttgaacacatacagactctggagggtcatcaccaggaaatatggtgtttggctgtaagccccagtggagactatgttgtatcatcgtcccatgacaaatctctgagactttgggagagaacaagggagcctcttattcttgaggaagaaagggagatggaaagagaagcagaatatgaggagagtgtggccaaagaagaccaaccagcagttccaggagagactcaaggtgacagttactttactggaaagaaaactattgaaacagtgaaagcagctgagaggattatggaggctattgagttgtaccgagaagaaactgcaaaaatgaaggaacacaaagccatttgtaaagctgcagggaaagaggttccacttcccagcaaccccatcctaatggcttatggcagtatctcaccttcagcttatgtattagagatttttaaagggatcaagtcgagtgagctggaagaatctctacttgtgctgcctttctcttatgtcccagacattcttaaactctttaacgaattcattcagctgggctctgatgttgaacttatatgccggtgcctcttcttcctccttaggattcactttggacagatcactagcaatcaaatgcttgtgccagtgatagaaaaattaagggaaacaactatttcaaaagtcagccaagtccgggatgttatcggcttcaatatggctggtcttgattatctcaagagggaatgcgaggcaaaaagtgaagttatgttttttgctgatgctactagccacttggaagagaagaagaggaagaggaaaaagagggagaagttgattctaacgttgacttagaactgaaatgtggtatctttttttttttcaactttttcctttaaaggactcctaaactaagcacagaagagttggcgtcatcttaaaaataccaaataacagaagatcgcattgcagatgatatcaggatgtggtttccagctttgcctgagggaattccaacatgagattatgggctggctccatttcttggacttaaaatgcattattagtttaaaaatctttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttatttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattctaattgctaactgtttatacttttctgaataaaatagttgtttctaattaaaaagtagccaagctaagatgcctggctgggcttctgaggaattaatacactcgtgtgcgtgtgtgtgtgtgtgtgtgtgtgtgtgtgtgtatgtgtatgtgtatgtacacatacatatatatagttgacacttgaaaaatgcaggtggtaggggcactgacccacccctacgccccgcacagtcaaaaatctgcatataacttttgattccccaaagtcttaagtactagtagcctgttattgactgggagcctgactgatgtattatatatattgtatactgtattcttaaagtaagctagagaaaagaaaatgttacttagaaaatcataaggaagagaaaatatatttactgtgtttatcaatact

SEQ ID NO: 459005 - DNA, 3466 bp, Homo sapiens
cgagacgggcgtgttaaaggccggttgctagggctgggggaactcagattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatctgggacttaaggaaaggagagaagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggacacagatattattgtatgggatgtgatcaatgaaagtggtctgtaccgtctaaaggggcacaaggatgccatcacacaagcattgtttctacgagaaaagaacctgctagttactagtgggaaagataccatggtgaaatggtgggaccttgatactcagcactgctttaaaacaatggttggccaccggactgaggtatgggggttggttctgttgtcagaagaaaagcgactcatcactggggcctcagacagtgaactgagggtatgggacatagcttatctgcaagagattgaagacccggaagaaccagaccccaagaaaatcaaaggatcttctcctggaatacaagatactcttgaggcagaggatggtgcctttgagacggatgaagcccctgaggatcgaatcctttcatgcagaaaagctggttccataatgcgggaaggaagagacagagttgtaaaccttgcagtcgacaagacaggcaggattcttgcttgccatggaactgactctgtgctagaattgttttgtatcctttccaaaaaggaaattcagaagaaaatggataagaagatgaagaaagctagaaagaaagcaaaattacattctagcaaaggagaggaggaagatcctgaggttaatgttgaaatgagtctgcaagatgaaatccagcgggtgactaatataaaaacttctgccaaaatcaagtcctttgacttgattcattcacctcacggagagttaaaggctgtcttcctgctgcagaacaacctggtggaattgtattcactgaatccatccttgcctactcctcagcctgtcaggacaagcagaatcactattgggggtcatcgcagtgatgtgcggactttgtcattcagctcagacaatattgctgttctttcagctgcagctgattccattaaaatatggaacaggtctacactgcagtgtattcgcacaatgacctgtgaatatgcactttgctcattctttgtacctggtgatagacaggtagtcataggaacaaagacagggaagctgcagctttatgacttggcttcagggaatctgctggagacaatagatgcacatgatggagctttgtggtccatgtccctctctccagatcagcgtggctttgtgacaggtggtgcagataaatctgtcaaattctgggattttgagttagtgaaagatgaaaatagtacccaaaagagactttctgtgaagcaaacccgaactttgcaactagatgaagatgttctgtgtgtcagttactctcccaatcaaaagctattggctgtgtctttgctggactgtactgtgaaaattttctacgttgatactttaaagttttttctgtcactgtatggacacaaactgcctgttatatgcatggacatctctcatgatggagcactcatagcaactggctccgctgataggaatgtgaaaatctggggtttggactttggggactgccacaagtctctctttgcacatgatgacagtgtgatgtacctacagtttgtacccaagtctcacctcttcttcactgccggaaaagatcataagattaaacagtgggatgcagacaaatttgaacacatacagactctggagggtcatcaccaggaaatatggtgtttggctgtaagccccagtggagactatgttgtatcatcgtcccatgacaaatctctgagactttgggagagaacaagggagcctcttattcttgaggaagaaagggagatggaaagagaagcagaatatgaggagagtgtggccaaagaagaccaaccagcagttccaggagagactcaaggtgacagttactttactggaaagaaaactattgaaacagtgaaagcagctgagaggattatggaggctattgagttgtaccgagaagaaactgcaaaaatgaaggaacacaaagccatttgtaaagctgcagggaaagaggttccacttcccagcaaccccatcctaatggcttatggcagtatctcaccttcagcttatgtattagagatttttaaagggatcaagtcgagtgagctggaagaatctctacttgtgctgcctttctcttatgtcccagacattcttaaactctttaacgaattcattcagctgggctctgatgttgaacttatatgccggtgcctcttcttcctccttaggattcactttggacagatcactagcaatcaaatgcttgtgccagtgatagaaaaattaagggaaacaactatttctctcaagagggaatgcgaggcaaaaagtgaagttatgttttttgctgatgctactagccacttggaagagaagaagaggaagaggaaaaagagggagaagttgattctaacgttgacttagaactgaaatgtggtatctttttttttttcaactttttcctttaaaggactcctaaactaagcacagaagagttggcgtcatcttaaaaataccaaataacagaagatcgcattgcagatgatatcaggatgtggtttccagctttgcctgagggaattccaacatgagattatgggctggctccatttcttggacttaaaatgcattattagtttaaaaatctttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttatttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattctaattgctaactgtttatacttttctgaataaaatagttgtttctaatta

SEQ ID NO: 459006 - DNA, 3318 bp, Homo sapiens
cgagacgggcgtgttaaaggccggttgctagggctgggggaactcagattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatctgggacttaaggaaaggagagaagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggacacagatattattgtatgggatgtgatcaatgaaagtggtctgtaccgtctaaaggggcacaaggatgccatcacacaagcattgtttctacgagaaaagaacctgctagttactagtgggaaagataccatggtgaaatggtgggaccttgatactcagcactgctttaaaacaatggttggccaccggactgaggtatgggggttggttctgttgtcagaagaaaagcgactcatcactggggcctcagacagtgaactgagggtatgggacatagcttatctgcaagagattgaagacccggaagaaccagaccccaagaaaatcaaaggatcttctcctggaatacaagatactcttgaggcagaggatggtgcctttgagacggatgaagcccctgaggatcgaatcctttcatgcagaaaagctggttccataatgcgggaaggaagagacagagttgtaaaccttgcagtcgacaagacaggcaggattcttgcttgccatggaactgactctgtgctagaattgttttgtatcctttccaaaaaggaaattcagaagaaaatggataagaagatgaagaaagctagaaagaaagcaaaattacattctagcaaaggagaggaggaagatcctgaggttaatgttgaaatgagtctgcaagatgaaatccagcgggtgactaatataaaaacttctgccaaaatcaagtcctttgacttgattcattcacctcacggagagttaaaggctgtcttcctgctgcagaacaacctggtggaattgtattcactgaatccatccttgcctactcctcagcctgtcaggacaagcagaatcactattgggggtcatcgcagtgatgtgcggactttgtcattcagctcagacaatattgctgttctttcagctgcagctgattccattaaaatatggaacaggtctacactgcagtgtattcgcacaatgacctgtgaatatgcactttgctcattctttgtacctggtgatagacaggtagtcataggaacaaagacagggaagctgcagctttatgacttggcttcagggaatctgctggagacaatagatgcacatgatggagctttgtggtccatgtccctctctccagatcagcgtggctttgtgacaggtggtgcagataaatctgtcaaattctgggattttgagttagtgaaagatgaaaatagtacccaaaagagactttctgtgaagcaaacccgaactttgcaactagatgaagatgttctgtgtgtcagttactctcccaatcaaaagctattggctgtgtctttgctggactgtactgtgaaaattttctacgttgatactttaaagttttttctgtcactgtatggacacaaactgcctgttatatgcatggacatctctcatgatggagcactcatagcaactggctccgctgataggaatgtgaaaatctggggtttggactttggggactgccacaagtctctctttgcacatgatgacagtgtgatgtacctacagtttgtacccaagtctcacctcttcttcactgccggaaaagatcataagattaaacagtgggatgcagacaaatttgaacacatacagactctggagggtcatcaccaggaaatatggtgtttggctgtaagccccagtggagactatgttgtatcatcgtcccatgacaaatctctgagactttgggagagaacaagggagcctcttattcttgaggaagaaagggagatggaaagagaagcagaatatgaggagagtgtggccaaagaagaccaaccagcagttccaggagagactcaaggtgacagttactttactggaaagaaaactattgaaacagtgaaagcagctgagaggattatggaggctattgagttgtaccgagaagaaactgcaaaaatgaaggaacacaaagccatttgtaaagctgcagggaaagaggttccacttcccagcaaccccatcctaatggcttatggcagtatctcaccttcagcttatgtattagagatttttaaagggatcaagtcgagtgagctggaagaatctctacttgtgctgcctttctcttatgtcccagacattcttaaactctttaacgaattcattcagctgggctctgatgttgaacttatatgccggtgcctcttcttcctccttaggattcactttggacagatcactagcaatcaaatgcttgtgccagtgatagaaaaattaagggaaacaactatttcaaaagtcagccaagtccgggactcctaaactaagcacagaagagttggcgtcatcttaaaaataccaaataacagaagatcgcattgcagatgatatcaggatgtggtttccagctttgcctgagggaattccaacatgagattatgggctggctccatttcttggacttaaaatgcattattagtttaaaaatctttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttatttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattctaattgctaactgtttatacttttctgaataaaatagttgtttctaatta

SEQ ID NO: 459007 - DNA, 1744 bp, Homo sapiens
  misc_feature (1709)..(1709): n is a, c, g, or t
  misc_feature (1731)..(1731): n is a, c, g, or t
cgagacgggcgtgttaaaggccggttgctagggctgggggaactcagattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatctgggacttaaggaaaggagagaagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggacacagatattattgtatgggatgtgatcaatgaaagtggtctgtaccgtctaaaggggcacaaggatgccatcacacaagcattgtttctacgagaaaagaacctgctagttactagtgggaaagataccatggtgaaatggtgggaccttgatactcagcactgctttaaaacaatggttggccaccggactgaggtatgggggttggttctgttgtcagaagaaaagcgactcatcactggggcctcagacagtgaactgagggtatgggacatagcttatctgcaagagattgaagacccggaagaaccagaccccaagaaaatcaaaggatcttctcctggaatacaagatactcttgaggcagaggatggtgcctttgagacggatgaagcccctgaggatcgaatcctttcatgcagaaaagctggttccataatgcgggaaggaagagacagagttgtaaaccttgcagtcgacaagacaggcaggattcttgcttgccatggaactgactctgtgctagaattgttttgtatcctttccaaaaaggaaattcagaagaaaatggataagaagatgaagaaagctagaaagaaagcaaaattacattctagcaaaggagaggaggaagatcctgaggttaatgttgaaatgagtctgcaagatgaaatccagcgggtgactaatataaaaacttctgccaaaatcaagtcctttgacttgattcattcacctcacggagagttaaaggctgtcttcctgctgcagaacaacctggtggaattgtattcactgaatccatccttgcctactcctcagcctgtcaggacaagcagaatcactattgggggtcatcgcagtgatgtgcggactttgtcattcagctcagacaatattgctgttctttcagctgcagctgattccattaaaatatggaacaggtctacactgcagtgtattcgcacaatgacctgtgaatatgcactttgctcattctttgtacctggtgatagacaggtagtcataggaacaaagacagggaagctgcagctttatgacttggcttcagggaatctgctggagacaatagatgcacatgatggagctttgtggtccatgtccctctctccagatcagcgtggctttgtgacaggtggtgcagataaatctgtcaaattctgggattttgagttagtgaaagatgaaaatagtacccaaaagagaactttctgtttaagccaanccccaactttggcacttaaatnaaaaattttctgt

SEQ ID NO: 459008 - DNA, 388 bp, Homo sapiens
tattcaaggatttctttgtttctggcaggttccaggagagactcaaggtgacagttactttactggaaagaaaactattgaaacagtgaaagcagtaagttgatatagaatgtggtatctcgttttttaataagatctcaactttttagtaaaagttttattctgtatcaaccagaaagccatttttttggcaaaaagttgatgagatttaaagatggggattataacctgtttccttctcttgtaaccaaagatgggagtagtcctgaatctctttgatcaatatgtgctcctttcaggtgttcctgggacctgccctattcagagtgtctagatatcatcccacctgagtccatgacactcagtctcttccctgtacattaaaaaa

SEQ ID NO: 459009 - DNA, 655 bp, Homo sapiens
cgagacgggcgtgttaaaggccggttgctagggctgggggaactcagattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatctgggacttaaggaaaggagagaagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggacacagatattattgtatgggatgtgatcaatgaaagtggtctgtaccgtctaaaggggcacaaggatgccatcacacaagcattgtttctacgagaaaagaacctgctagttactagtgggaaagataccatggtgagaatggtgggaccctgatactccccggctgctaacaggtccggctcgacttctatt

SEQ ID NO: 459010 - DNA, 3520 bp, Homo sapiens
cgagacgggcgtgttaaaggccggttgctagggctgggggaactcagattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatctgggacttaaggaaaggagagaagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggacacagatattattgtatgggatgtgatcaatgaaagtggtctgtaccgtctaaaggggcacaaggatgccatcacacaagcattgtttctacgagaaaagaacctgctagttactagtgggaaagataccatggtgaaatggtgggaccttgatactcagcactgctttaaaacaatggttggccaccggactgaggtatgggggttggttctgttgtcagaagaaaagcgactcatcactggggcctcagacagtgaactgagggtatgggacatagcttatctgcaagagattgaagacccggaagaaccagaccccaagaaaatcaaaggatcttctcctggaatacaagatactcttgaggcagaggatggtgcctttgagacggatgaagcccctgaggatcgaatcctttcatgcagaaaagctggttccataatgcgggaaggaagagacagagttgtaaaccttgcagtcgacaagacaggcaggattcttgcttgccatggaactgactctgtgctagaattgttttgtatcctttccaaaaaggaaattcagaagaaaatggataagaagatgaagaaagctagaaagaaagcaaaattacattctagcaaaggagaggaggaagatcctgaggttaatgttgaaatgagtctgcaagatgaaatccagcgggtgactaatataaaaacttctgccaaaatcaagtcctttgacttgattcattcacctcacggagagttaaaggctgtcttcctgctgcagaacaacctggtggaattgtattcactgaatccatccttgcctactcctcagcctgtcaggacaagcagaatcactattgggggtcatcgcagtgatgtgcggactttgtcattcagctcagacaatattgctgttctttcagctgcagctgattccattaaaatatggaacaggtctacactgcagtgtattcgcacaatgacctgtgaatatgcactttgctcattctttgtacctggtgatagacaggtagtcataggaacaaagacagggaagctgcagctttatgacttggcttcagggaatctgctggagacaatagatgcacatgatggagctttgtggtccatgtccctctctccagatcagcgtggctttgtgacaggtggtgcagataaatctgtcaaattctgggattttgagttagtgaaagatgaaaatagtacccaaaagagactttctgtgaagcaaacccgaactttgcaactagatgaagatgttctgtgtgtcagttactctcccaatcaaaagctattggctgtgtctttgctggactgtactgtgaaaattttctacgttgatactttaaagttttttctgtcactgtatggacacaaactgcctgttatatgcatggacatctctcatgatggagcactcatagcaactggctccgctgataggaatgtgaaaatctggggtttggactttggggactgccacaagtctctctttgcacatgatgacagtgtgatgtacctacagtttgtacccaagtctcacctcttcttcactgccggaaaagatcataagattaaacagtgggatgcagacaaatttgaacacatacagactctggagggtcatcaccaggaaatatggtgtttggctgtaagccccagtggagactatgttgtatcatcgtcccatgacaaatctctgagactttgggagagaacaagggagcctcttattcttgaggaagaaagggagatggaaagagaagcagaatatgaggagagtgtggccaaagaagaccaaccagcagttccaggagagactcaaggtgacagttactttactggaaagaaaactattgaaacagtgaaagcagctgagaggattatggaggctattgagttgtaccgagaagaaactgcaaaaatgaaggaacacaaagccatttgtaaagctgcagggaaagaggttccacttcccagcaaccccatcctaatggcttatggcagtatctcaccttcagcttatgtattagagatttttaaagggatcaagtcgagtgagctggaagaatctctacttgtgctgcctttctcttatgtcccagacattcttaaactctttaacgaattcattcagctgggctctgatgttgaacttatatgccggtgcctcttcttcctccttaggattcactttggacagatcactagcaatcaaatgcttgtgccagtgatagaaaaattaagggaaacaactatttcaaaagtcagccaagtccgggatgttatcggcttcaatatggctggtcttgattatctcaagagggaatgcgaggcaaaaagtgaagttatgttttttgctgatgctactagccacttggaagagaagaagaggaagaggaaaaagagggagaagttgattctaacgttgacttagaactgaaatgtggtatctttttttttttcaactttttcctttaaaggactcctaaactaagcacagaagagttggcgtcatcttaaaaataccaaataacagaagatcgcattgcagatgatatcaggatgtggtttccagctttgcctgagggaattccaacatgagattatgggctggctccatttcttggacttaaaatgcattattagtttaaaaatctttctgtgctctcaaagcttgagccttgcagctcaagcttgttgttccctttatattctagcagggaataaataattgttttaattaggtatttgtttcattggagttgaaattaacatttcaaaagtttttcgtatttttttatggcagatgatttgtcatttatttatattaggttttactgcctattgagacaaccaggtgcataattgattgccctttggccataaaaatgcagtgtcatggatcttagagctaaaaaggactgtaaaaattacccagaacagcgtcctcagacttaaccttctgcaagttatgtctgtatataagaagattctaattgctaactgtttatacttttctgaataaaatagttgtttctaatta

SEQ ID NO: 459011 - DNA, 2759 bp, Homo sapiens
cgagacgggcgtgttaaaggccggttgctagggctgggggaactcagattgcttcacctgtggtatcagacatcacaacatggggctcaccaagcagtacctacgctatgttgctagtgcggtctttggcgttatcggcagccaaaaaggtaatattgtctttgtgacacttcgtggtgagaaaggacgttatgtggcagtaccagcttgtgaacacgttttcatctgggacttaaggaaaggagagaagattcttatccttcaggggcttaaacaagaagttacttgcttatgcccctccccagatgggctacacttagctgttgggtatgaggatgggtcgatccgaatcttcagtctcctgagtggggaaggaaatgtgaccttcaatggtcacaaagcagctatcactaccttgaagtatgatcagctaggaggcagactggcatctgggtccaaggacacagatattattgtatgggatgtgatcaatgaaagtggtctgtaccgtctaaaggggcacaaggatgccatcacacaagcattgtttctacgagaaaagaacctgctagttactagtgggaaagataccatggtgaaatggtgggaccttgatactcagcactgctttaaaacaatggttggccaccggactgaggtatgggggttggttctgttgtcagaagaaaagcgactcatcactggggcctcagacagtgaactgagggtatgggacatagcttatctgcaagagattgaagacccggaagaaccagaccccaagaaaatcaaaggatcttctcctggaatacaagatactcttgaggcagaggatggtgcctttgagacggatgaagcccctgaggatcgaatcctttcatgcagaaaagctggttccataatgcgggaaggaagagacagagttgtaaaccttgcagtcgacaagacaggcaggattcttgcttgccatggaactgactctgtgctagaattgttttgtatcctttccaaaaaggaaattcagaagaaaatggataagaagatgaagaaagctagaaagaaagcaaaattacattctagcaaaggagaggaggaagatcctgaggttaatgttgaaatgagtctgcaagatgaaatccagcgggtgactaatataaaaacttctgccaaaatcaagtcctttgacttgattcattcacctcacggagagttaaaggctgtcttcctgctgcagaacaacctggtggaattgtattcactgaatccatccttgcctactcctcagcctgtcaggacaagcagaatcactattgggggtcatcgcagtgatgtgcggactttgtcattcagctcagacaatattgctgttctttcagctgcagctgattccattaaaatatggaacaggtctacactgcagtgtattcgcacaatgacctgtgaatatgcactttgctcattctttgtacctggtgatagacaggtagtcataggaacaaagacagggaagctgcagctttatgacttggcttcagggaatctgctggagacaatagatgcacatgatggagctttgtggtccatgtccctctctccagatcagcgtggctttgtgacaggtggtgcagataaatctgtcaaattctgggattttgagttagtgaaagatgaaaatagtacccaaaagagactttctgtgaagcaaacccgaactttgcaactagatgaagatgttctgtgtgtcagttactctcccaatcaaaagctattggctgtgtctttgctggactgtactgtgaaaattttctacgttgatactttaaagttttttctgtcactgtatggacacaaactgcctgttatatgcatggacatctctcatgatggagcactcatagcaactggctccgctgataggaatgtgaaaatctggggtttggactttggggactgccacaagtctctctttgcacatgatgacagtgtgatgtacctacagtttgtacccaagtctcacctcttcttcactgccggaaaagatcataagattaaacagtgggatgcagacaaatttgaacacatacagactctggagggtcatcaccaggaaatatggtgtttggctgtaagccccagtggagactatgttgtatcatcgtcccatgacaaatctctgagactttgggagagaacaagggagcctcttattcttgaggaagaaagggagatggaaagagaagcagaatatgaggagagtgtggccaaagaagaccaaccagcagttccaggagagactcaaggtgacagttactttactggaaagaaaactattgaaacagtgaaagcagctgagaggattatggaggctattgagttgtaccgagaagaaactgcaaaaatgaaggaacacaaagccatttgtaaagctgcagggaaagaggttccacttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaaggggtaattaaaaaaaaaataggatttt

SEQ ID NO: 459012 - DNA, 884 bp, Homo sapiens
gcggcagcggaaggtgggagcgacgactgcaaaacggcagcgatggggtgggtaggcaggccgctttcagcgcgcttctaacaaggtggagagaggcgcttcacttccctaccgcccttaccgccgctccgtcttgtctcccaccgactcacagggaggcttgctgctcctccgcggccgttacagagagcggggcttctgcggccgctaccgtttccctggggctaggttgcttcgcagaaggctctggccctgagtccgagggggactgcggggtccaggggcgatgaatgctcccgcaacctccggagcttgtgcgcgtacttcagggaccggcaccacgtcaccgtcacctcctgagtagtgagttcccctctgatgaaaccactggtgtgtttactcaccatccccaccatttttttttccccaacctgatggaaggaagtacataatggagagcaagtttttaaagcacggtcgtgtcgtgtgaacttgctctagccaaattaggtttatagcactttttttggctctcattacctccagtccccacataaacaagagtgaccagctgggtcatccgcaagaccgtttgaaattattgtggcttgggtggaaacttaaaggagtgaagtatctgctttccagaaaaatcgttgtcattcaaagtgaaattaaacttgttttctttgcaataattcgcctttatttccttgtatatctgtaaactcttcacttttttgtaattactagacaattcggacttaaaaagagcctcagcatgtgtattttggaattgtgtagcttcataatgtgaaaattattcttttctatttgagtaaagtacagttaatttgaagtaaataaaatttctatttccaaaa

SEQ ID NO: 459013 - DNA, 151 bp, Homo sapiens
gcagaaggctctggccctgagtccgagggggactgcggggtccaggggcgatgaatggtgaggtggcttcagtccgccctccccggggacgctgagcgtgttcgtgttcgtgtttgtgtttgtgtttgtgttggacacccccgcccccgca

SEQ ID NO: 459014 - DNA, 638 bp, Homo sapiens
gcggcagcggaaggtgggagcgacgactgcaaaacggcagcgatgggctcccgcaacctccggagcttgtgcgcgtacttcagggaccggcaccacgtcaccgtcacctcctgagtagtgagttcccctctgatgaaaccactggtgtgtttactcaccatccccaccatttttttttccccaacctgatggaaggaagtacataatggagagcaagtttttaaagcacggtcgtgtcgtgtgaacttgctctagccaaattaggtttatagcactttttttggctctcattacctccagtccccacataaacaagagtgaccagctgggtcatccgcaagaccgtttgaaattattgtggcttgggtggaaacttaaaggagtgaagtatctgctttccagaaaaatcgttgtcattcaaagtgaaattaaacttgttttctttgcaataattcgcctttatttccttgtatatctgtaaactcttcacttttttgtaattactagacaattcggacttaaaaagagcctcagcatgtgtattttggaattgtgtagcttcataatgtgaaaattattcttttctatttgagtaaagtacagttaatttgaagtaaataaaatttctatttccaaaa

SEQ ID NO: 459015 - DNA, 299 bp, Homo sapiens
  misc_feature (10)..(10): n is a, c, g, or t
  misc_feature (29)..(29): n is a, c, g, or t
  misc_feature (44)..(44): n is a, c, g, or t
aatgttgggnaaattccaccaccaagganggtaaggattttccnggctcttacttcaatagttgtctaaactaggaaaggtaccctggactgccattctacgcagttgagagaacactggatgtgttgttgactgctgtagctcaatgtctagcaaaataagcgtttgataaattaaaaaatgaattaatttaaacttattaaaggaaagactggtaacccaaaactctcttctctaatgtattttttaacgaaaatgacaatatttctttaataaagtatttataccaaaaaaaaaaa

SEQ ID NO: 459016 - DNA, 4275 bp, Homo sapiens
tcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaatgtgtgtatttattttggtcatttttacgagaagcactttattccctctccctctcactgatcacaaatggaatcacctccctgggcagcgagacgcagttgctctgggaagatgccacagtgaccagggccatggccggtccctctggggagatgggacacggctcctggcagcacccaggagccccccaggctgcctgcctgcgtgcagaggcaggagaggaccgtggagcgtttccgggactgcattttagacggagtgaaatgtacatgaatttggcttttgctagagtctgtgtatggttttttaaggtcctttttccctttctgtttgtaaggtaagagcttctgttcgtgtgcagggaaagcagctcacagacgccgttaaaaccagcttcatctttccttcaggatcatccttttgtacttgatgctggaagctcttggagaaaaagcttaaacatttcaccagaaatcttaattgagcagcagtcatatcgccacagctttgtgagtacacagctaacagatgcgtcgagacctgagatgtgctcgtttttattcctcctctcccagattggctccagcagaaaagtccctcgtgcacaggcagctcttgtgccggcactacttgaaaacatggctactttctaagctacaaaccattagaaaataagcccgtcacccacaccttgagcacacaccatgaagatcaccagcttggatggccgtcacctcagacatcactccagggagcacccgcaggagctgggccccctcacgcctgccttcctgggccagcttcctgcttgcagtcactcgcatagcacagaggtggggcttcgggcagggagcggagattcctcataggtgagtccaaatgacctccagcctctcgaaggcatcaagacaaattgaaagaaagcaataactcaccaaagctcaacgctgcccctgcctcgacctccatgggtctcttcgtgttcctcgtttcaccccagaaagtggaggtttcctcttggcattttcggaggaaacttgtaggacacccaaggcgactaagagacagcctccttggcaagggcaggcaccactttgtagcaacttgggcaccagcttttctggacagcctggcttcttactggcattgtccaactcatcccttctcgaagcatgtctttgccatgggctgtgtccttccagggaaattgtggtctccggcctgggtgagacaatgaagtgacttccaaccgacagttgctagaattcacagggcagaaaaggggttgaccttctccccttctggctttccacccggcctgctgcttgctgtcgccactcatgtctcctccacatgcggtccacacatcagtaagggcctggagatgtgtaaagacacagcaaggggcaagcagactcttggccacgtgtttccagtggctggaccacgccgacacctgggatcttgagatacccaggaagggaggctgtctggccagcctctccctgcctccacttgctccacgtccagctcatcctcaccttccctcttttttaaagtcacatttccatgtttcaacattagtttgcattcacctttacaaaggcctttctttagatctgtgcagcctttgcgtgccaaacttgtgaaattccttttaccttttttggagtacttgctataaagccacctgtcaacaaacccccattatgtacagaataggacctatccagtagccaggccagtaggcagttggggaaggtgggaaggatccagcgaggcccctgagcctgcacctggacaggtgtacgtctgcacccatcaccctcagcaccaggccaccctgcagtccacttactgtactgtgttgtggaaggatatgctaagtgatgaaagttgcgagcagtctcactggtcgtgtaaacttttttttttttttggaaattgaagctgtagagtgctgcccgaaatctctaggaagttggtggcaagggacagcactcacactcttctggtcatgatctctgatctccacctcaaatgacaataaaaaactggtccaacgaagacactgctcagcacttcagccatcaggactaatccatcgatgactggaaaagaggctagctttgaggaaaacagcctgggctcttgggagcagagtccagtgggtgtgaggctgacttgccgacggtcggcaggtaatggctctcagccggcgaggcggtcccacagctctcctcccagggcagcctgaggaggaggaggccgggtgcctgtttggtggcagcttcagcctagggatacctgaagctgttgagcaacacctttatgaaatgttgccagagcagcaacacttccctgtgggcacagccccgggaaatccggtaccaagtgagcaaggtggcaggacccacccaagcctgatacgcatctgggcccgccgggctcagcaggggaggctgctacggctgcccacttcccagcaccgtctgtcaggcttgaacccctctgtgctgttcccttcctggctaatagggagacccttcgcaggcacccactgtttcaacttgaccctcccaccccctgctactctcctccacacacccctccgttccgctagcctaccctgtcagcctttcaataaaagttatgcacaaatgtgaacacctgagatggagctgaacatttcttcactttgttctttttctgaagtcaaactcttatcaaatgccctaaaattattaccacccaagagaaacaggaaaaaggttacatgtttttgtttactgagagtaagatcacctgcatctggaagacgggctggtaaattggtttggctacagaacagaaagaaaacaaaaacaaacctcgtaagggaagtatcgcactcagacaccaccacttcctagagccaaatgagcaatcccaaactgcaagtgccgtaagtgggcctgtgacgtcacaccgcccggcccgaggtatcgcatgtgcgggggaggcccacactacagctgtcctctcgtctagaaggcaccacctcgctttcatgtcccgtgtgttttggaaaagcagtatggtgtgtcatgtctagcggcgaacacttccctccctctgtccttgaggttgtaatataaaaactgtgtttctgtacgtgtgggtgggaattctctgacggtgctcgttcatagcacaagcttacgctgagttctgaactgtcgttcacagctgcgtgtctgcatggtgtcgcatctgttgtacctttggggaaaatttgtatgtaaatgtacagaaataaaaacgttgccccattaacagatttcctctggaatgtcttccctacctcacctgatggtatccaccgaagggcatttcactaccattaatggtgagtaataaaatcctccgtgttcattcagacctcactgcgtcactactttgaacgcctctgtaagctgtgtcttcactcgccccgaggtgggtggagggaggcctctcactctgcttcgagtcctggtcttaaaggtagtcagaggcagaggctggattaaacacacactgtttaccaagtgccactctcagaccacctgagagacggggggccatcagtaaaattaagaggaatttttttcccttgttcgtgtatgttctgctgatccgtggcctgaaggttcctagagacgtcaagaaatgaatatcttacactgtgattctgtgaggaaagactggtaacccaaaactctcttctctaatgtattttttaacgaaaatgacaatatttctttaataaagtatttataccaaaaaaaaaaa

SEQ ID NO: 459017 - DNA, 617 bp, Homo sapiens
ccgggggatgatacggggtacattataaaacacagattactgcatttaataaatatatagttatctatcaggagtgagccttagctcttcatcagtaaataaaaacgttgccccattaacagatttcctctggaatgtcttccctacctcacctgatggtatccaccgaagggcatttcactaccattaatggtgagtaataaaatcctccgtgttcattcagacctcactgcgtcactactttgaacgcctctgtaagctgtgtcttcactcgccccgaggtgggtggagggaggcctctcactctgcttcgagtcctggtcttaaaggtagtcagaggcagaggctggattaaacacacactgtttaccaagtgccactctcagaccacctgagagacggggggccatcagtaaaattaagaggaatttttttcccttgttcgtgtatgttctgctgatccgtggcctgaaggttcctagagacgtcaagaaatgaatatcttacactgtgattctgtgaggaaagactggtaacccaaaactctcttctctaatgtattttttaacgaaaatgacaatatttctttaataaagtatttataccaaaaaaaaaaa

SEQ ID NO: 459018 - DNA, 4332 bp, Homo sapiens
tcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaatgtgtgtatttattttggtcatttttacgagaagcactttattccctctccctctcactgatcacaaatggaatcacctccctgggcagcgagacgcagttgctctgggaagatgccacagtgaccagggccatggccggtccctctggggagatgggacacggctcctggcagcacccaggagccccccaggctgcctgcctgcgtgcagaggcaggagaggaccgtggagcgtttccgggactgcattttagacggagtgaaatgtacatgaatttggcttttgctagagtctgtgtatggttttttaaggtcctttttccctttctgtttgtaaggtaagagcttctgttcgtgtgcagggaaagcagctcacagacgccgttaaaaccagcttcatctttccttcaggatcatccttttgtacttgatgctggaagctcttggagaaaaagcttaaacatttcaccagaaatcttaattgagcagcagtcatatcgccacagctttgtgagtacacagctaacagatgcgtcgagacctgagatgtgctcgtttttattcctcctctcccagattggctccagcagaaaagtccctcgtgcacaggcagctcttgtgccggcactacttgaaaacatggctactttctaagctacaaaccattagaaaataactcaaaaagatggcagaggcaaatccacagaaggggggctgccctccacacacacacgcccgtcacccacaccttgagcacacaccatgaagatcaccagcttggatggccgtcacctcagacatcactccagggagcacccgcaggagctgggccccctcacgcctgccttcctgggccagcttcctgcttgcagtcactcgcatagcacagaggtggggcttcgggcagggagcggagattcctcataggtgagtccaaatgacctccagcctctcgaaggcatcaagacaaattgaaagaaagcaataactcaccaaagctcaacgctgcccctgcctcgacctccatgggtctcttcgtgttcctcgtttcaccccagaaagtggaggtttcctcttggcattttcggaggaaacttgtaggacacccaaggcgactaagagacagcctccttggcaagggcaggcaccactttgtagcaacttgggcaccagcttttctggacagcctggcttcttactggcattgtccaactcatcccttctcgaagcatgtctttgccatgggctgtgtccttccagggaaattgtggtctccggcctgggtgagacaatgaagtgacttccaaccgacagttgctagaattcacagggcagaaaaggggttgaccttctccccttctggctttccacccggcctgctgcttgctgtcgccactcatgtctcctccacatgcggtccacacatcagtaagggcctggagatgtgtaaagacacagcaaggggcaagcagactcttggccacgtgtttccagtggctggaccacgccgacacctgggatcttgagatacccaggaagggaggctgtctggccagcctctccctgcctccacttgctccacgtccagctcatcctcaccttccctcttttttaaagtcacatttccatgtttcaacattagtttgcattcacctttacaaaggcctttctttagatctgtgcagcctttgcgtgccaaacttgtgaaattccttttaccttttttggagtacttgctataaagccacctgtcaacaaacccccattatgtacagaataggacctatccagtagccaggccagtaggcagttggggaaggtgggaaggatccagcgaggcccctgagcctgcacctggacaggtgtacgtctgcacccatcaccctcagcaccaggccaccctgcagtccacttactgtactgtgttgtggaaggatatgctaagtgatgaaagttgcgagcagtctcactggtcgtgtaaacttttttttttttttggaaattgaagctgtagagtgctgcccgaaatctctaggaagttggtggcaagggacagcactcacactcttctggtcatgatctctgatctccacctcaaatgacaataaaaaactggtccaacgaagacactgctcagcacttcagccatcaggactaatccatcgatgactggaaaagaggctagctttgaggaaaacagcctgggctcttgggagcagagtccagtgggtgtgaggctgacttgccgacggtcggcaggtaatggctctcagccggcgaggcggtcccacagctctcctcccagggcagcctgaggaggaggaggccgggtgcctgtttggtggcagcttcagcctagggatacctgaagctgttgagcaacacctttatgaaatgttgccagagcagcaacacttccctgtgggcacagccccgggaaatccggtaccaagtgagcaaggtggcaggacccacccaagcctgatacgcatctgggcccgccgggctcagcaggggaggctgctacggctgcccacttcccagcaccgtctgtcaggcttgaacccctctgtgctgttcccttcctggctaatagggagacccttcgcaggcacccactgtttcaacttgaccctcccaccccctgctactctcctccacacacccctccgttccgctagcctaccctgtcagcctttcaataaaagttatgcacaaatgtgaacacctgagatggagctgaacatttcttcactttgttctttttctgaagtcaaactcttatcaaatgccctaaaattattaccacccaagagaaacaggaaaaaggttacatgtttttgtttactgagagtaagatcacctgcatctggaagacgggctggtaaattggtttggctacagaacagaaagaaaacaaaaacaaacctcgtaagggaagtatcgcactcagacaccaccacttcctagagccaaatgagcaatcccaaactgcaagtgccgtaagtgggcctgtgacgtcacaccgcccggcccgaggtatcgcatgtgcgggggaggcccacactacagctgtcctctcgtctagaaggcaccacctcgctttcatgtcccgtgtgttttggaaaagcagtatggtgtgtcatgtctagcggcgaacacttccctccctctgtccttgaggttgtaatataaaaactgtgtttctgtacgtgtgggtgggaattctctgacggtgctcgttcatagcacaagcttacgctgagttctgaactgtcgttcacagctgcgtgtctgcatggtgtcgcatctgttgtacctttggggaaaatttgtatgtaaatgtacagaaataaaaacgttgccccattaacagatttcctctggaatgtcttccctacctcacctgatggtatccaccgaagggcatttcactaccattaatggtgagtaataaaatcctccgtgttcattcagacctcactgcgtcactactttgaacgcctctgtaagctgtgtcttcactcgccccgaggtgggtggagggaggcctctcactctgcttcgagtcctggtcttaaaggtagtcagaggcagaggctggattaaacacacactgtttaccaagtgccactctcagaccacctgagagacggggggccatcagtaaaattaagaggaatttttttcccttgttcgtgtatgttctgctgatccgtggcctgaaggttcctagagacgtcaagaaatgaatatcttacactgtgattctgtgaggaaagactggtaacccaaaactctcttctctaatgtattttttaacgaaaatgacaatatttctttaataaagtatttataccaaaaaaaaaaa

SEQ ID NO: 459019 - DNA, 3015 bp, Homo sapiens
tcatctgcatcatctgcatcctcctgctgcccgagagcagggaccagaacctgcctgagaacatttctaacggggagcactacacgcgccagccgctgctgccgcacaagaagggggagcagccactgctgctcaccaacgccgagctcaaggactactcgggcctccacgatgccgcagccgcgggtgacacactgcccgagggtgccacggccaacggcatgaaggccatgtagcccggcctgcggaacccggggctccagggtctggggcagcttgggcacaggtttacagaccagggaccgaacacgcagccaggggtgggaaagctgcctcagccaagctgagcctctcaactggtgtggggaaatcctgtctttccaaaagtccaaggagcgcgggtcggaggagacaaactctttggaaataaccctttcaagactttcttttctgccgttaaatgtgtgtatttattttggtcatttttacgagaagcactttattccctctccctctcactgatcacaaatggaatcacctccctgggcagcgagacgcagttgctctgggaagatgccacagtgaccagggccatggccggtccctctggggagatgggacacggctcctggcagcacccaggagccccccaggctgcctgcctgcgtgcagaggcaggagaggaccgtggagcgtttccgggactgcattttagacggagtgaaatgtacatgaatttggcttttgctagagtctgtgtatggttttttaaggtcctttttccctttctgtttgtaaggtaagagcttctgttcgtgtgcagggaaagcagctcacagacgccgttaaaaccagcttcatctttccttcaggatcatccttttgtacttgatgctggaagctcttggagaaaaagcttaaacatttcaccagaaatcttaattgagcagcagtcatatcgccacagctttgtgagtacacagctaacagatgcgtcgagacctgagatgtgctcgtttttattcctcctctcccagattggctccagcagaaaagtccctcgtgcacaggcagctcttgtgccggcactacttgaaaacatggctactttctaagctacaaaccattagaaaataactcaaaaagatggcagaggcaaatccacagaaggggggctgccctccacacacacacgcccgtcacccacaccttgagcacacaccatgaagatcaccagcttggatggccgtcacctcagacatcactccagggagcacccgcaggagctgggccccctcacgcctgccttcctgggccagcttcctgcttgcagtcactcgcatagcacagaggtggggcttcgggcagggagcggagattcctcataggtgagtccaaatgacctccagcctctcgaaggcatcaagacaaattgaaagaaagcaataactcaccaaagctcaacgctgcccctgcctcgacctccatgggtctcttcgtgttcctcgtttcaccccagaaagtggaggtttcctcttggcattttcggaggaaacttgtaggacacccaaggcgactaagagacagcctccttggcaagggcaggcaccactttgtagcaacttgggcaccagcttttctggacagcctggcttcttactggcattgtccaactcatcccttctcgaagcatgtctttgccatgggctgtgtccttccagggaaattgtggtctccggcctgggtgagacaatgaagtgacttccaaccgacagttgctagaattcacagggcagaaaaggggttgaccttctccccttctggctttccacccggcctgctgcttgctgtcgccactcatgtctcctccacatgcggtccacacatcagtaagggcctggagatgtgtaaagacacagcaaggggcaagcagactcttggccacgtgtttccagtggctggaccacgccgacacctgggatcttgagatacccaggaagggaggctgtctggccagcctctccctgcctccacttgctccacgtccagctcatcctcaccttccctcttttttaaagtcacatttccatgtttcaacattagtttgcattcacctttacaaaggcctttctttagatctgtgcagcctttgcgtgccaaacttgtgaaattccttttaccttttttggagtacttgctataaagccacctgtcaacaaacccccattatgtacagaataggacctatccagtagccaggccagtaggcagttggggaaggtgggaaggatccagcgaggcccctgagcctgcacctggacaggtgtacgtctgcacccatcaccctcagcaccaggccaccctgcagtccacttactgtactgtgttgtggaaggatatgctaagtgatgaaagttgcgagcagtctcactggtcgtgtaaacttttttttttttttggaaattgaagctgtagagtgctgcccgaaatctctaggaagttggtggcaagggacagcactcacactcttctggtcatgatctctgatctccacctcaaatgacaataaaaaactggtccaacgaagacactgctcagcacttcagccatcaggactaatccatcgatgactggaaaagaggctagctttgaggaaaacagcctgggctcttgggagcagagtccagtgggtgtgaggctgacttgccgacggtcggcaggtaatggctctcagccggcgaggcggtcccacagctctcctcccagggcagcctgaggaggaggaggccgggtgcctgtttggtggcagcttcagcctagggatacctgaagctgttgagcaacacctttatgaaatgttgccagagcagcaacacttccctgtgggcacagccccgggaaatccggtaccaagtgagcaaggtggcaggacccacccaagcctgacagacggtgctgggaagtgggcagccgtagcagcctcccctgctgagcccggcgggcccaaatgcgtat

SEQ ID NO: 459020 - DNA, 638 bp, Homo sapiens
tatactaaaattggaacgatacagagaagattagcatggcccctgcgcaaggatgacacgcaaattcgtgaagcgttccatatttttagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcgatttcactaacgttgtatatgaaaatgtctgcaataaaaagtacttttaaactttgta

SEQ ID NO: 459021 - DNA, 4342 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttca

SEQ ID NO: 459022 - DNA, 1830 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcgatttcactaacgttgtatatgaaaatgtctgcaataaaaagtacttttaaactttgta

SEQ ID NO: 459023 - DNA, 1929 bp, Homo sapiens
tttttatgacattatgtttatttttggctacatccagaaaagaatttgataaggcttaaactattaaaacatgtgcaacaggctattaaaggaaacaaaataactagaagccagttaggaggactagttcagcttttgaatggagctattcaacagtttcagaaattttttttacgctactaatgggccagtgggcatagcatctttttaagcttccttccagtttgtggtactaaaaccattgcagatgcataaaggaagatgcttatcatcctgtctgagttgtaagatgggacacaactccttatcatagtacattccttaaataagtacaagaattacagttgacccttgaacgtcacaagtttgaactgcacaggtccacttatatgtggatttttttcaaccaaatgcagattgcaaatgcacaagattcgagacctatgtatacagagggccaacttttcatacgcacgggttctgcgggccgactgtgggacttgaatatgcgtggatttggttgaggctgtgaagctgggcagggtttcagctgagctgaggttggaagtccctgaccttcagctgtggccgcctacggagcagcagggagagcaaacccatggagaaccccgcggcccccaaagcatggacggagctgccagccttctcccctgcccttcttcctctactcccgacctgccagccttctcccctgcccttctgcctctactcccgacctgccaaccttagcctaaaatcagagctgctagaatcacacacactgtcgtagctggttttgtattgtaaatgagtcattctgttattttggaaacttatgtctcatgccaggatctgcagatagttctttttcaaaatattgtttagacaaaataaatttctttaaatataatatctctactttaaatgcctggggtgttgcatgcatttttctaggctagcaaagcttaaagattatttctataatttcagttacatttacctttatagatgggttactctaagtaacaaattaaacacacatggatcttctaactttggctttaaatcctaagaagagataggtaatatataaaagagtattaaaaagaaatggagagtaaaggtatatgtcgggcagatgcagtagaaaagcaagggtcatgacgtcaatgctgggcaaagctaaattgtgaagacaaaacaataatgaaacagggttattcatcacgctaaagcgtacagtccataggatgatataactaccatgaatttggcctaaatgattgaacattgaaacacataaagcgagaactgtaggggattaaagacaaaatcagtgagtgcagtgctggtgggagaggcgcctggacttcttggcccctcacaggtcatgtggtagacataagttgttattactgtgagccagtagagactttcaggtttgatggctggaaaacaaatgctcattttataagtttttttttgttttgtgttttgttttgttttgtttttgagacggagtttcactcttgttgcccaggctggagtgcagtggtgcgatctcggctcaccgcaacctccgccccttgggttcaagcgattctcctgcctcagcctcccaagtagctgggattacagtcatgcaccaccacgcccagctcattttgtatttttttttagtagagatggggtttctccatgtcagtcaggctagtcctcaactcccgatctcaggtgatccgcccacctcagcctcccaaagtgctgggattacaggcgtgagccaccgtgcccgaccctcatggtataagtttttaaacttaatatatactagcttacagaggaaaccgatgtgatttccaaaaatttgaaataattagaaaccttattctcacattataatgcaataaaaatagaaataaacacaca

SEQ ID NO: 459024 - DNA, 1473 bp, Homo sapiens
ccaggttagttgatcttatggtgtcatctagaaaaacaagagatgcagattctgggtcacgaagttgaggctgtgaagctgggcagggtttcagctgagctgaggttggaagtccctgaccttcagctgtggccgcctacggagcagcagggagagcaaacccatggagaaccccgcggcccccaaagcatggacggagctgccagccttctcccctgcccttcttcctctactcccgacctgccagccttctcccctgcccttctgcctctactcccgacctgccaaccttagcctaaaatcagagctgctagaatcacacacactgtcgtagctggttttgtattgtaaatgagtcattctgttattttggaaacttatgtctcatgccaggatctgcagatagttctttttcaaaatattgtttagacaaaataaatttctttaaatataatatctctactttaaatgcctggggtgttgcatgcatttttctaggctagcaaagcttaaagattatttctataatttcagttacatttacctttatagatgggttactctaagtaacaaattaaacacacatggatcttctaactttggctttaaatcctaagaagagataggtaatatataaaagagtattaaaaagaaatggagagtaaaggtatatgtcgggcagatgcagtagaaaagcaagggtcatgacgtcaatgctgggcaaagctaaattgtgaagacaaaacaataatgaaacagggttattcatcacgctaaagcgtacagtccataggatgatataactaccatgaatttggcctaaatgattgaacattgaaacacataaagcgagaactgtaggggattaaagacaaaatcagtgagtgcagtgctggtgggagaggcgcctggacttcttggcccctcacaggtcatgtggtagacataagttgttattactgtgagccagtagagactttcaggtttgatggctggaaaacaaatgctcattttataagtttttttttgttttgtgttttgttttgttttgtttttgagacggagtttcactcttgttgcccaggctggagtgcagtggtgcgatctcggctcaccgcaacctccgccccttgggttcaagcgattctcctgcctcagcctcccaagtagctgggattacagtcatgcaccaccacgcccagctcattttgtatttttttttagtagagatggggtttctccatgtcagtcaggctagtcctcaactcccgatctcaggtgatccgcccacctcagcctcccaaagtgctgggattacaggcgtgagccaccgtgcccgaccctcatggtataagtttttaaacttaatatatactagcttacagaggaaaccgatgtgatttccaaaaatttgaaataattagaaaccttattctcacattataatgcaataaaaatagaaataaacacaca

SEQ ID NO: 459025 - DNA, 608 bp, Homo sapiens
ctccttttacagtactggtccctttacactgtactgcatactcgttttttcagtggatatatgagcttcttgtcaaaattatgtgggtcccatgaagaaacatctaaccaggggaagggggaaggattgagacataagacgtacttatataagatttcttttaagaattccaatcttggacatgttaaatttttttatattttctcatgtttaaatctcagttcgtttttcatgctgtgctcagcacgtaagtgtggggaaatggagcaggggggctgcgggaggagccgctggctgggctcaacatgcctgtgccttttccccttcagtgtgttcttgtgtctgatgcatctctaacacagatgacattttactgtttttcagagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcgatttcactaacgttgtatatgaaaatgtctgcaataaaaagtacttttaaactttgta

SEQ ID NO: 459026 - DNA, 672 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgaggtaagttattgtgtgtttcactgaatcggaaccttccgtgggtagttaataaatggctattgtgcttcagataagaaaagcaggaagtcctttctagcagaattcaccccatttcgctgcagacttaaccagaggaggttgggtgtgtcactgcagtttggcattttacgaactacttacagaatttgaggcttgaaagaggccttgcatgcatagttcaaagct

SEQ ID NO: 459027 - DNA, 528 bp, Homo sapiens
tccagcaagccatccacttgtgtctttcaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcggcacaacttcgtatgggcactcggcgtgtggcaacaacttcgtccatactgatttgcggccagagcctgagtctggatttacggcgttgcaggtaccgactg

SEQ ID NO: 459028 - DNA, 871 bp, Homo sapiens
cattgattaagctgttttatgctcattttattttctctttcaaagctctgtgttgccattattaaaattaatttttctgtcctcagggaataagatgaaaagaaactgacatttataggaaatcaagtattgccattattgtcctctttataattttgtcttaactatatttgttcaagtttcaatgtttttaattcagtttctgagcaaggtcgtttttggctactgtcagctggagacagtgagtggagtggcctctgtggctatgtgagagccactgtgaagaaagtctcgggatgtgtggctgtcagaaaacaagtaacgcggaatgagcaggccttgcattttagaccttagggatcctgtgcgatgtgggactgttggaatatggagcagcctgagagtggagaggcgagggctcagcaggaatgcgtgctcccaggctcaccgtgcggttttctttataggacaatacatggcttgatatacaacgccctgaagctcttcatggagatgaaccaaaagctatttgatgactgtacacaacagttcaaagcagagaaactaaagtgagttgttcctttcacaagttactgtttccaggatttttttcttaatcctaagtaaacctcttccactgttttgtcctaaaacggtattcttcactcgaaagcaaaaccaagcctttcatacttggaaagcaaattaaaactgtgttataataacgtattttgaaagaacaggtgtttaaaggtagctattctccccccttgtattgccagattaatcatctttgcaaaaagtgcttatgtaagcaagaatttaacattcagaattttttcttttcttgggctataatgggcttaaaggc

SEQ ID NO: 459029 - DNA, 595 bp, Homo sapiens
ggcggccgcgggggcgcgacggccggggcgggggcgctgctgctgcgggggcaggcggcggcaggggcggcggcggcggcggcggcccgctccagccatgccgaataaaaacaagaaggagaaagaatcaccaaaagcagggaagagtggaaaaagttcaaaagaaggacaagacacagtagaatcagagtgctactgtctaagagctggagctacagagcttgaaattaccactgaaaacactgaaatgttgggcccttcactgcttcctcataaggataccagaggcaacctggcatattaagcttgacacttggcagatcactgtgtaaattgtttttcaggaatacaagttgggacacttctgttcatttgacctttgagttgacccttaaattttattattgttttttttcccctcagtcttcagctcactgcttcacttctagttccacccacttaccaaatatgattgactcatgcaggtgaattaaaccattattgcacactttttccctctcctctctctcagtattactcttaacttgaatattttaacctgaacaatttaaataggcttgacattcccatgctg

SEQ ID NO: 459030 - DNA, 504 bp, Homo sapiens
actcactcactaatatttagaaatcacccacttggtggttggctctgtgcttagtgctaagaactggtcgtgttataggtgctgtgggtgcgtgtctgcgctggcttcaggaggagggagcaggccctgtggggcccagcaaggcctcccaggagaagcagtgtgttagctgaagtttaatgaactaattggtggtcctgggatgcagttgggaagatgggatgattcagcctgttggggtatgtgttgggggtggttgttgcactgtggtgagaaaattcctggaaaagggtgtatgtcaaaagggtgtaagtagcatccctttatgactgatgaaaggagagcagccgagagcagttaagtggaaggcaagacgcagcagtggcttctcacgccatcttcgtcactacacaaggggaagttgggctaagaataaatttgttttggttccaggatgaaactcaagagatacagaagaaactgaaagtgatacttttggcagag

SEQ ID NO: 459031 - DNA, 260 bp, Homo sapiens
caaaattagatatattctttttattcgtaatgatatagcatgaagttcttgcggggtaggagagagaggtattcatctgaaaactggctctgttttagtgtagacatttgtctacggggaaacagtaggaaagcatcaagaaatatttcttgatgtgtacaattgaagtgatgtttacaatgtagtgaaaaaaaaacctatgcacgcatgttcctgattttaataaagctctgcaaagatttccttcctcattctttgct

SEQ ID NO: 459032 - DNA, 4535 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaatataggtaagtggcacaattatttttctttagaaaatatctgtaactttatgcattagtgaaatgttaagtaccgacatattttttaacattttgtaattcaaaactttttgttttgacattgtttatgaagagaaacttcatacacttgccatttaatatgctcttttatctaattttcaaaaactctaaaaaacggtgtatcatatggactaaataaagaacatgtgaattttattgctcatcatgaaactaa

SEQ ID NO: 459033 - DNA, 4189 bp, Homo sapiens
ggcggccgcgggggcgcgacggccggggcgggggcgctgctgctgcgggggcaggcggcggcaggggcggcggcggcggcggcggcccgctccagccatgccgaataaaaacaagaaggagaaagaatcaccaaaagcagggaagagtggaaaaagttcaaaagaaggacaagacacagtagaatcagagcaaatttccgtcaggaaaaacagccttgttgctgtcccgtctacagtatctgctaaaataaaagtaccagtctctcagcccatagtgaagaaagacaaacggcaaaattcttcaaggtttagcgcaagcaataatagagaacttcaaaaactaccatccttaaaagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaa

SEQ ID NO: 459034 - DNA, 4106 bp, Homo sapiens
tgcggagggcgggaccaaccaggaaaggacgggactgtcgggaatcaccaaaagcagggaagagtggaaaaagttcaaaagaaggacaagacacagtagaatcagagcaaatttccgtcaggaaaaacagccttgttgctgtcccgtctacagtatctgctaaaataaaagtaccagtctctcagcccatagtgaagaaagacaaacggcaaaattcttcaaggtttagcgcaagcaataatagagaacttcaaaaactaccatccttaaaagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaa

SEQ ID NO: 459035 - DNA, 2017 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcgatttcactaacgttgtatatgaaaatgtctgcaataaaaagtacttttaaactttgtacaacagataatagcactagataacagcaaaacaacttgttgggggcgccgggcgcagagaaattttaaacctcggttgggggccggcccgtgtgtaatcgcacggtgcaaccggtccagaggaccgggctgaacgggggggtccaccaaaaacgcgggccggtttgacacacaggggcgggcagggc

SEQ ID NO: 459036 - DNA, 4072 bp, Homo sapiens
actcactcactaatatttagaaatcacccacttggtggttggctctgtgcttagtgctaagaactggtcgtgttataggtgctgtgggtgcgtgtctgcgctggcttcaggaggagggagcaggccctgtggggcccagcaaggcctcccaggagaagcagtgtgttagctgaagtttaatgaactaattggtggtcctgggatgcagttgggaagatgggatgattcagcctgttgggatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaa

SEQ ID NO: 459037 - DNA, 3777 bp, Homo sapiens
gcctgttctgctcagttgctccctgtggcctcggccagaatggtggtctcttcctctgtggcatgtctgtgactcttgggcagcaggcctcttccagagggacggctgtttcctctcccccaagacctacagcctcgtctctggtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaa

SEQ ID NO: 459038 - DNA, 2086 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcagggtcttgctctgatacccaggctggaatgcagtggcacaatcttggctcactgcagcctcggcctcctggactcaagcaatccgcccacttcagcctcccaagcagcagtgactaccggcaccaccacactcagctgatttttgtatttttagcagagatggagttttaacatgttggctaggctggtctcaaactcctggtctcaagtgatctgcctgccttggcctcccaaagtgctgggattatgggcatgagccaccgcgcccagccaataaacttttcttaagtt

SEQ ID NO: 459039 - DNA, 2049 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagcacagaaagatccgaagaaggaccatcctcttcgacttcctccagaatttgcgccatttccacttccccatgatgtactctgggagtttgctgcaccagattcccacacaccacctcctttgtttgtgttaacttgaaagttagtgcccataggaccatttacgccaggctgcattagagttgcattcacagtgtcaccattagcttggccattagggcctgaacatttgtctccagagtaattagaaccataggcaccccatgtagtaccataagagcctccactttttgactctccattgctaaggtgagaaagggaagtgccttcataactgatggagcctgcaactcagatgcttcttaacgggat

SEQ ID NO: 459040 - DNA, 3205 bp, Homo sapiens
tatactaaaattggaacgatacagagaagattagcatggcccctgcgcaaggatgacacgcaaattcgtgaagcgttccatatttttagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaa

SEQ ID NO: 459041 - DNA, 1621 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagtaagaaagaactggctgccatctttttcagtcattttaaaatatggcacgttttactgctacttcagtaagaataaatatcagaattttaaatatcaattaaaaaacaagaaggtc

SEQ ID NO: 459042 - DNA, 1825 bp, Homo sapiens
  misc_feature (996)..(996): n is a, c, g, or t
  misc_feature (1009)..(1011): n is a, c, g, or t
  misc_feature (1014)..(1014): n is a, c, g, or t
  misc_feature (1024)..(1024): n is a, c, g, or t
  misc_feature (1033)..(1033): n is a, c, g, or t
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttatagccactccatgaaangagcatcatatgnnntangcaggttacnggaaatatngggatataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcgatttcactaacgttgtatatgaaaatgtctgcaataaaaagtacttttaaactttgta

SEQ ID NO: 459043 - DNA, 1457 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccaggtggcatactgtgtagtgcagttttagagcaggaccgcacctcatgaaccaggggtgttgcgacttctcaaatactggccaagactcactgtccaagcgaagtaaggtcttcaccgactcaacacgtttagatggtcttgcaccttcgggattgtgaggtctggaaccctcttcggagcggccaactgtttccggccacttccatgtgggaggacctctatacgggaagaacatctccgcacgcgcacgagattgctagtctcgtacgacaacctggactcatggtcacgggcctcgaccctgagg

SEQ ID NO: 459044 - DNA, 979 bp, Homo sapiens
attctacagggagaaagagatagccaatacataggaataaatatatacaaggtatcatgtagtgataattgctgtggagaaaaataaagcgggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaa

SEQ ID NO: 459045 - DNA, 1682 bp, Homo sapiens
tgcggagggcgggaccaaccaggaaaggacgggactgtcgggaatcaccaaaagcagggaagagtggaaaaagttcaaaagaaggacaagacacagtagaatcagagcaaatttccgtcaggaaaaacagccttgttgctgtcccgtctacagtatctgctaaaataaaagtaccagtctctcagcccatagtgaagaaagacaaacggcaaaattcttcaaggtttagcgcaagcaataatagagaacttcaaaaactaccatccttaaaagttgaggctgtgaagctgggcagggtttcagctgagctgaggttggaagtccctgaccttcagctgtggccgcctacggagcagcagggagagcaaacccatggagaaccccgcggcccccaaagcatggacggagctgccagccttctcccctgcccttcttcctctactcccgacctgccagccttctcccctgcccttctgcctctactcccgacctgccaaccttagcctaaaatcagagctgctagaatcacacacactgtcgtagctggttttgtattgtaaatgagtcattctgttattttggaaacttatgtctcatgccaggatctgcagatagttctttttcaaaatattgtttagacaaaataaatttctttaaatataatatctctactttaaatgcctggggtgttgcatgcatttttctaggctagcaaagcttaaagattatttctataatttcagttacatttacctttatagatgggttactctaagtaacaaattaaacacacatggatcttctaactttggctttaaatcctaagaagagataggtaatatataaaagagtattaaaaagaaatggagagtaaaggtatatgtcgggcagatgcagtagaaaagcaagggtcatgacgtcaatgctgggcaaagctaaattgtgaagacaaaacaataatgaaacagggttattcatcacgctaaagcgtacagtccataggatgatataactaccatgaatttggcctaaatgattgaacattgaaacacataaagcgagaactgtaggggattaaagacaaaatcagtgagtgcagtgctggtgggagaggcgcctggacttcttggcccctcacaggtcatgtggtagacataagttgttattactgtgagccagtagagactttcaggtttgatggctggaaaacaaatgctcattttataagtttttttttgttttgtgttttgttttgttttgtttttgagacggagtttcactcttgttgcccaggctggagtgcagtggtgcgatctcggctcaccgcaacctccgccccttgggttcaagcgattctcctgcctcagcctcccaagtagctgggattacagtcatgcaccaccacgcccagctcattttgtatttttttttagtagagatggggtttctccatgtcagtcaggctagtcctcaactcccgatctcaggtgatccgcccacctcagcctcccaaagtgctgggattacaggcgtgagccaccgtgcccgaccctcatggtataagtttttaaacttaatatatactagcttacagaggaaaccgatgtgatttccaaaaatttgaaataattagaaaccttattctcacattataatgcaataaaaatagaaataaacacaca

SEQ ID NO: 459046 - DNA, 482 bp, Homo sapiens
gtaaggttgtacttttagggtttgtggttatggatgaaattaacttatctgagccttacattgtctcactaggcacagtgcccacttgttccgtggcacagccccagagctcctgttgaaggaacagactccaggactgactttccacttgattttcggagctcgcacatcccgagagattcatgttcaagctgcattttagacatagctggcaagagtattttcgtggtaaacgtaaacttactattggtaaagattcttaatgagtaattcttaggatttagtacaaaattagatatattctttttattcgtaatgatatagcatgaagttcttgcggggtaggagagagaggtattcatctgaaaactggctctgttttagtgtagacatttgtctacggggaaacagtaggaaagcatcaagaaatatttcttgatgtgtacaattgaagtgatgtttacaatgtagtgaaaaaaaaa

SEQ ID NO: 459047 - DNA, 4059 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcata

SEQ ID NO: 459048 - DNA, 1856 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagttgaggctgtgaagctgggcagggtttcagctgagctgaggttggaagtccctgaccttcagctgtggccgcctacggagcagcagggagagcaaacccatggagaaccccgcggcccccaaagcatggacggagctgccagccttctcccctgcccttcttcctctactcccgacctgccagccttctcccctgcccttctgcctctactcccgacctgccaaccttagcctaaaatcagagctgctagaatcacacacactgtcgtagctggttttgtattgtaaatgagtcattctgttattttggaaacttatgtctcatgccaggatctgcagatagttctttttcaaaatattgtttagacaaaataaatttctttaaatataatatctctactttaaatgcctggggtgttgcatgcatttttctaggctagcaaagcttaaagattatttctataatttcagttacatttacctttatagatgggttactctaagtaacaaattaaacacacatggatcttctaactttggctttaaatcctaagaagagataggtaatatataaaagagtattaaaaagaaatggagagtaaaggtatatgtcgggcagatgcagtagaaaagcaagggtcatgacgtcaatgctgggcaaagctaaattgtgaagacaaaacaataatgaaacagggttattcatcacgctaaagcgtacagtccataggatgatataactaccatgaatttggcctaaatgattgaacattgaaacacataaagcgagaactgtaggggattaaagacaaaatcagtgagtgcagtgctggtgggagaggcgcctggacttcttggcccctcacaggtcatgtggtagacataagttgttattactgtgagccagtagagactttcaggtttgatggctggaaaacaaatgctcattttataagtttttttttgttttgtgttttgttttgttttgtttttgagacggagtttcactcttgttgcccaggctggagtgcagtggtgcgatctcggctcaccgcaacctccgccccttgggttcaagcgattctcctgcctcagcctcccaagtagctgggattacagtcatgcaccaccacgcccagctcattttgtatttttttttagtagagatggggtttctccatgtcagtcaggctagtcctcaactcccgatctcaggtgatccgcccacctcagcctcccaaagtgctgggattacaggcgtgagccaccgtgcccgaccctcatggtataagtttttaaacttaatatatactagcttacagaggaaaccgatgtgatttccaaaaatttgaaataattagaaaccttattctcacattataatgcaataaaaatagaaataaacacaca

SEQ ID NO: 459049 - DNA, 695 bp, Homo sapiens
ggcggccgcgggggcgcgacggccggggcgggggcgctgctgctgcgggggcaggcggcggcaggggcggcggcggcggcggcggcccgctccagccatgccgaataaaaacaagaaggagaaagaatcaccaaaagcagggaagagtggaaaaagttcaaaagaaggacaagacacagtagaatcagagcaaatttccgtcaggaaaaacagccttgttgctgtcccgtctacagtatctgctaaaataaaagtaccagtctctcagcccatagtgaagaaagacaaacggcaaaattcttcaaggtttagcgcaagcaataatagagaacttcaaaaactaccatccttaaaagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtgccagttaacagggtttcgaaacatttacccacttttcttccaatccttcggggagcgggaatttggacccggggggaagaaggaacccaaccgttgaaaagaaaccctggccctctattaaccgctttggtttatta

SEQ ID NO: 459050 - DNA, 4280 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaa

SEQ ID NO: 459051 - DNA, 4419 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaaaaaaaaaaaaaagaaaaaagaaaacaaggaaaatagagagcagatagcggcaaggacaacgagggaagagagacacaggcgaacgagagaaggaagacgaattaggcgtgcgcgcacgcagagcaacagaggaggctcg

SEQ ID NO: 459052 - DNA, 4135 bp, Homo sapiens
gaccaaccagggaggggcgggctgtcggatgggcgggacctcgcgggaggagctgcggaaagctgagctggaatcaccaaaagcagggaagagtggaaaaagttcaaaagaaggacaagacacagtagaatcagagcaaatttccgtcaggaaaaacagccttgttgctgtcccgtctacagtatctgctaaaataaaagtaccagtctctcagcccatagtgaagaaagacaaacggcaaaattcttcaaggtttagcgcaagcaataatagagaacttcaaaaactaccatccttaaaagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaa

SEQ ID NO: 459053 - DNA, 4436 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgaggcacagtgcccacttgttccgtggcacagccccagagctcctgttgaaggaacagactccaggactgactttccacttgattttcggagctcgcacatcccgagagattcatgttcaagctgcattttagacatagctggcaagagtattttcgtgatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaa

SEQ ID NO: 459054 - DNA, 3957 bp, Homo sapiens
ggcggccgcgggggcgcgacggccggggcgggggcgctgctgctgcgggggcaggcggcggcaggggcggcggcggcggcggcggcccgctccagccatgccgaataaaaacaagaaggagaaaatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaa

SEQ ID NO: 459055 - DNA, 4011 bp, Homo sapiens
  misc_feature (615)..(615): n is a, c, g, or t
  misc_feature (628)..(630): n is a, c, g, or t
  misc_feature (633)..(633): n is a, c, g, or t
  misc_feature (643)..(643): n is a, c, g, or t
  misc_feature (652)..(652): n is a, c, g, or t
cacatgaagccgttctagcatgctggagtgtgatggccgtctcgaagaaaagcgcccatgtgatgtatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttatagccactccatgaaangagcatcatatgnnntangcaggttacnggaaatatngggatataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaa

SEQ ID NO: 459056 - DNA, 1908 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggtggcagagcgagctctctattactggaataatgaatacatcatgagtttaatcagtgacaacgcagcgaagattctgcccatcatgtttccttccttgtaccgcaactcaaagacccattggaacaagacaatacatggcttgatatacaacgccctgaagctcttcatggagatgaaccaaaagctatttgatgactgtacacaacagttcaaagcagagaaactaaagtgagttgttcctttcacaagttactgtttccaggatttttttcttaatcctaagtaaacctcttccactgttttgtcctaaaacggtattcttcactcgaaagcaaaaccaagcctttcatacttggaaagcaaattaaaactgtgttataataacgtattttgaaagaacaggtgtttaaaggtagctattctccccccttgtattgccagattaatcatctttgcaaaaagtgcttatgtaagcaagaatttaacattcagaattttttcttttcttgggctataatgggcttaaaggc

SEQ ID NO: 459057 - DNA, 1702 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagcttgtttatgaatttttcttaagatttttagagtctccagatttccaacctaatatagcgaagaaatatattgatcagaagtttgtattgcagcttttagagctctttgacagtgaagatcctcgggagagagattttcttaaaaccacccttcacagaatctatgggaaattcctaggcttgagagcttacatcagaaaacagataaataatatattttataggtttatttatgaaacagagcatcataatggcatagcagagttactggaaatattgggaagtataattaatggatttgccttaccactaaaagaagagcacaagattttcttattgaaggtgttactacctttgcacaaagtgaaatctctgagtgtctaccatccccagctggcatactgtgtagtgcagtttttagaaaaggacagcaccctcacggaaccagtggtgatggcacttctcaaatactggccaaagactcacagtccaaaagaagtaatgttcttaaacgaattagaagagattttagatgtcattgaaccatcagaatttgtgaagatcatggaacccctcttccggcagttggccaaatgtgtctccagcccacacttccaggacaatacatggcttgatatacaacgccctgaagctcttcatggagatgaaccaaaagctatttgatgactgtacacaacagttcaaagcagagaaactaaaagagaagctaaaaatgaaagaacgggaagaagcatgggttaaaatagaaaatctagccaaagccaatccccaggtactaaaaaagagaataacatgaaaacgcccagggttacttgaatgtttttataagataggaatatatgtcttcaccatggggggggtctcgatttcactaacgttgtatatgaaaatgtctgcaataaaaagtacttttaaactttgta

SEQ ID NO: 459058 - DNA, 3175 bp, Homo sapiens
ctccttttacagtactggtccctttacactgtactgcatactcgttttttcagtggatatatgagcttcttgtcaaaattatgtgggtcccatgaagaaacatctaaccaggggaagggggaaggattgagacataagacgtacttatataagatttcttttaagaattccaatcttggacatgttaaatttttttatattttctcatgtttaaatctcagttcgtttttcatgctgtgctcagcacgtaagtgtggggaaatggagcaggggggctgcgggaggagccgctggctgggctcaacatgcctgtgccttttccccttcagtgtgttcttgtgtctgatgcatctctaacacagatgacattttactgtttttcagagagaagctaaaaatgaaagaacgggaagaagcatgggttaaaatagaaaatctagccaaagccaatccccagtacacagtgtatagtcaagccagcaccatgagcattccggttgcaatggagacagatgggcctttatttgaagatgtgcagatgctgagaaagacagtgaaggacgaggctcatcaggcacagaaagatccgaagaaggaccgtcctcttgcacgccgcaagtccgagctgcctcaggacccccacaccaagaaagccttggaagctcactgcagggccgatgagctggcctcccaggacggccgctagcctccggggcgccgcgtcggggccgggcccgccagttcttttccggattctgtagaaaatacatacttcctgtgccataccaatcagttacactcaaagctttcttggaccccgttccgtaggcaataacgtgcgtccgcctcagcgcgagattaggagttcaaacaatggtgacttcccagagcccgctggcagagccgcgggttgacgacggtgtcctcgcagtgtcgccgccaccccagcgtagtccaagtcagactatttcacaaagtcagagcgataggaaagcaccctgcccttcatcttcatgttctcccaaatggaacttaggatcttttaacataggtggttctgtgataacatcagtgttttccaaatcaaaggaacgctttaaaaaataggacctattttttaagactttacagcctttgaaatggtttccacgtgattgttacgccagcagttctcgttttgtttgtttttcaatctcagtgaaatggctctttgctttcgagttctcacgcaacgtactgggcaaatgacaatcctcagccgctggtattttctaaggggtctcttcactttgatgagtgacatgaacaccgtgtctccttctcttgtgtgtacctaaagccatatttccaagtctgtggtactccaggattccaggagtaagcctgtagaagagatttattttaaaagagattgctctgaaatttatcttaaaagagcttgctctgtctaccttgacagaaattggagttttaaaattatgtgttaatatttttatttgcagatttcgtttccgtcaacttaaacattgttgcccttcaacaaggctcttgaattaataaaattatagtctctaagaattccacattttatggaaagttagagcaaaatcattttgagttaagccagttcttagcctaatgcaaactgcagcgcctttaagcataaagtaacacaacagcattgcacggggccggcactgccgctgccttcactgaaggctgcagtgctgttctgagagcttggaggaggcaccagcgaggatgacgtttagtggagctctttctgttgaaaagagctcacgttatcaacaccttgtaaggaaaatacagtgtctgagttttcatcggtcttcacatgctgctatatattccacagagttccttgcatgtactgagcttttgttttagatggaatagcacaaggagaaaaatctttaaacttagtgctttgtctattctttatttctctcagggtggccagtattttgacttatttatcctgcttgaaagctacttgagatgtgtactgctattctaaacacgtgatctagtttctttcatctctggcataagattatataacttaatgttaagtgtcttgaggcataaaagacaaaatgtggcttattttaggatctgttttttcatcgaggtctcgggtatcctttcaaagatagtgagaagcagacactgctccttgtgcagctctggtacctcctgcccactgctgtcacttcaagccactggcaatgcttctgtcctcgtgtcttggaggaaaatcacctggggggaggggacttcttgtggtaagagcaagtgcaggtatgaaatgcgaagattgccccagctaaaagtggacaagtccgctttgtgagatgaatacttcctgagaaacttgacaagtatctctccattttaccattatgaaaactatcattaaaaaaaacagtttagatgccttctccttttgagggaaaaagggtgctttttattgtataaagcagcgtcttatgtattttgatataccattgtttgaacttccgtctttagctgatagattctcaaatatccttgattttggatgttcagtatgtttgtgagagaggtttctgggaagactctctttttgccctcgggaaaaagcaaaatatcaatgtttgggtgactgtgtaaagctcagtgtgtaagaacatctttttgtctaggttttctttctgctctttattgaagacaaacactcaccaaaaagaaaaataaaagttttcagagaaactaattttctttggcaagagtattacttaatattttggcctcctaaagtttccctagttagtactcggactcctgtgctaattgtcagcttacatatcattgtatagagactgtttattctgtaccaaactgatttcaaaagtactacattgaaaataaaccggtgactgtttttcttcataaagttctgcgtttggcatcttcactctttccaaaatgtatctgtacatcagaaatgtcactattccaagtgtctttttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaa

SEQ ID NO: 459059 - DNA, 916 bp, Homo sapiens
cgaaatcatttgtttacagtctggccaaggttgtggcctccagtattccccctaagagatgggatctttgcctaaaagttactgagaaacgaaggctgcaaaaagccggaaaatatcccagcttttaaggcacactgacagccaaacagaacgctctttccgtttgcagtttttttagtgtcattttaagttgcagcttccggccaatcagcgagcttcatgcctgctgacatcacgaaccagccagttccctccagctgcagagagcttcagtttgtctttttttttttaaactaaaatggaggctggtttcttgccttaaggagcccattgcctttcccgctgaagtctagatgttgacatgtaataaagcgggcagcaggatggtggtggatgcggccaactccaatgggcctttccagcccgtggtccttctccatattcgagatgttcctcctgctgatcaagagaagctttttatccagaagttacgtcagtgttgcgtcctctttgactttgtttctgatccactaagtgacctaaagtggaaggaagtaaaacgagctgctttaagtgaaatggtagaatatatcacccataatcggaatgtgatcacagagcctatttacccagaagtagtccatatgtttgcagttaacatgtttcgaacattaccaccttcctccaatcctacgggagcggaatttgacccggaggaagatgaaccaacgttagaagcagcctggcctcatctacagccttgtttatgcatttttcttgagatttttagattctcccatgatatcccacctcatatagcagaaagccaatactcttgatcagaacttttcctcgctgcattctcagagctcttgaccaatcaagatccccgggtgagaacttctcccagccaccc

SEQ ID NO: 459060 - DNA, 3023 bp, Homo sapiens
ggtgcaattattgtcattgttgttatttatcatcatcagtatcattacaaaggctcagctggaaggcctgaagtgcccattatacacatagggaaactgaggcccagagaggggtcaaggcttgcacagagttgcccctgggggaaggaggcaggactcggactctggcctcagtttccccacctgagaaacaggccacataactctagtgacctcctgggggaagggcagtcaggcccttgggtggggcttaggcttgaccactggccacctgaggtaccttggaactctggccctgagtgcctcgctattctctgccttctgtgtgtcactgtgccccatgagtgcctccaatgtccttctgtattcccaccctctaccacactgttcccaatctgtgtttttagggtgctcgcttgtcccccaccctctgccctctgtcctatctcctgactgatacctgtattacctctcaccgggccctcaatgccccagcctcatgacctactcttcctggactgtctgtgctcccagccagccttgtcccatcaccccagccttgtatgtgcaccttcagggcccctgtccctctgacacccccatcctgccccccacaggaacctgctgtacgtgtacccgcacagcctcaacttcagcagccgccagggctccgtgcgcaaccttgctgtgcgagtgcagtacatgacaggcgaggaccccagccaggctctgccggtcagtggctgtgccccagggaaggggggtagggcatcccccatgggtccctcatgaatccactctcccaggtcatctttggcaagtccagctgcagtgaatttacccgcgaggccttcacaccggtggtctaccataacaagtatgtagggggacacgtgaggaacttgggggcactcatgggggtaggaggatgtcccttatatatacacataaggcagcatcgatgggaagatgggggacaggaagaagagaggtagaggctcccagagtgctaatgagggaagctgaggcagacagcagagacagtggggcctagcagcaataagggcgtggcatggcagaggtgatggggcagacagtggggaccccagcccccagcagatcccccagcccgattctgccaggtcccccgagttctacgaggagttcaagctgcatcttccagcctgcgtgacagagaaccatcacctgctgttcaccttctaccatgtcagctgccagccccggccgggcactgccctggagacacccgtgggctttactgtgagccgtcccctccctccctccccctgagccctcctcgtcccccaacctggccgcagacctgacctccagcctctccccagtggatcccactgctgcagcacgggcgcctgaggaccggccccttctgtctcccagtgtctgtggaccagccgccgcccagctattccgtgctcacacccgatgtatgtgccctggagctcctgcctgccaatgcactgtccccagaagcactcccgagtcacctgccttccttcctgtcaatcctgggaggcttgttatcctctactggtgcctccagggcccccgtgtagctcattattcccctattaatgcctctctgtgtcctacatgtcctccccaaagattcccattgcctctctgctccattcccactttagccaccctgactgccttcctgatcactgtcccctgccctcgtagtaccttatcattccccatgaatgcaccattgttaatgaccctaggcctcaaatcctcctatcctgtttcctgacctactcaatgaatattcattcaccctgtgtctccattctctgcccccgtcttggcatgtggatttccagcctgcccagtggaccctctcagtctactgggaccagggctgggggcagggtgcttggctgcacccccagaccgggctacactcacgctgcagtgtcgcaatggctggggccgctgggtgacctgatcagtcagggagggctgaccagtgcccacctggtgcctccctcccacaggtggcgcttccgggcatgcgctgggtggacggtcacaagggcgtgttcagtgtggagctcacagccgtgtcctctgtgcacccccaggtacggggtgggccgggaaccaagagtcccgccctgctcccctcttgcctgccctacgattgagtaacagttgccgatggccggggaggtctggcctcaggccttggacgtgactttggtcagctggacccagctttaagggaagctgctgattcaggcaggggtggtcttcattccctgaggccccaccctgctcactccacatccctacccaggacccctacctggacaaattcttcaccctggtgcacgtcctggaggagggagccttcccattccggctcaaggacactgtgctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattggtaagcgaatgtggcctcagacctcagtttccccatccacatggcttctcagtcctgaggtcctgagggatcttctataagcccatttacctctctggccatttttctcatctgaaaaatgacctccagtcccctgcacccagagaaggtcttctgtgaccctttggcccgggtgcagcggttcacgcctgtcatcccagcactttgggaggccgaggcaggcagatcacctgaggtcgagagtttgagaccagcctgaccaacatggagaaaccccttctctactaaaaatacaaaattagctgggcgtggtggcgcatgcctgtaatcccagctactcgggaggctgaggcaggagaattgcttgaacctgggaggcggaggtgacagtgagccgagatcatgccactggactccagcccgggcaacagagcaagactccatctc

SEQ ID NO: 459061 - DNA, 6358 bp, Homo sapiens
gacgcgaggaccatggctgcctccgagcgccgcgccttcgcgcacaagatcaacaggacggtggccgcagaggtgcggaagcaggtgtcccgggaacgcagtggctccccccactccagcaggcgctgcagcagctccctgggggtcccactgactgaagttgtcgagcccctggactttgaggatgtacttctgagccggccaccagatgctgagcccgggcccctcagggacctggtagaattcccagctgatgacttggagctgctgctgcagccccgggaatgccggaccacggagcccgggatccccaaggatgaaaaactggatgcccaggtgagggccgcggtggagatgtatattgaggactgggtcattgtccacagaaggtatcagtacctgagtgcagcatacagccccgtcaccacagacacacagcgggagcgacagaagggcctcccccgccaggtctttgagcaggatgcttctggagacgagaggtccggccctgaggactcgaatgactcccggcgtggctcgggctccccggaagacacccctcgaagcagtggtgcctctagcatcttcgacctgaggaacctggcagctgactcattgctgccctctctgctagagcgggcggccccagaagatgtggaccggcgcaatgaaacccttcgacggcagcaccggcccccggccctgctcaccctctacccggcacctgacgaggatgaagccgtggaacgctgtagccgcccagagccaccccgcgagcactttggacaaaggatcttggtcaagtgtctgtcgctcaagttcgagattgaaattgagcccatctttgggatcttggctctgtatgatgtgcgggagaaaaagaagatctcggagaacttctacttcgacctgaactcggactccatgaaggggctgcttcgggctcatggcacccaccctgccatctccaccctggcccgctctgccatcttctctgtgacctacccctcacctgacatcttcctggtcatcaagttggagaaggtgcttcagcaaggggacatcagtgagtgctgtgagccttacatggtgttgaaagaagtggacacagccaagaacaaagagaagctagagaagctgcgcctggcggccgagcagttctgcacccgcctgggccgctaccgcatgcccttcgcctggacggccgtgcacttggccaacatcgtgagcagcgctgggcagctggaccgggactctgactcggagggcgagcgccggccagcctggacagaccgccgccgtcgggggccccaggaccgggcgagtagtggggacgacgcctgcagcttctctggcttccgtccagccacgctaactgtcacaaacttctttaagcaggaggctgagcgactcagtgacgaggacctcttcaagttcctggctgacatgaggcgcccgtcgtccctgctgcggcgactacgtcctgtgactgcccagctcaagatcgacatttctccggctcctgaaaatccccacttctgcctctcccctgagctgcttcatatcaagccctacccggaccccaggggccggcccaccaaggagattctggagttccccgcccgcgaagtctatgccccccataccagctacaggaacctgctgtacgtgtacccgcacagcctcaacttcagcagccgccagggctccgtgcgcaaccttgctgtgcgagtgcagtacatgacaggcgaggaccccagccaggctctgccggtcatctttggcaagtccagctgcagtgaatttacccgcgaggccttcacaccggtggtctaccataacaagtcccccgagttctacgaggagttcaagctgcatcttccagcctgcgtgacagagaaccatcacctgctgttcaccttctaccatgtcagctgccagccccggccgggcactgccctggagacacccgtgggctttacttggatcccactgctgcagcacgggcgcctgaggaccggccccttctgtctcccagtgtctgtggaccagccgccgcccagctattccgtgctcacacccgatgtggcgcttccgggcatgcgctgggtggacggtcacaagggcgtgttcagtgtggagctcacagccgtgtcctctgtgcacccccaggacccctacctggacaaattcttcaccctggtgcacgtcctggaggagggagccttcccattccggctcaaggacactgtgctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattgtgaacctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaagctgcttcacgaggagctggctctgcagtgggtggtcagcagcagtgccgtacgcgaggccatcctccagcacgcctggttcttcttccagctcatggtgaagagtatggcgctgcacctgctgcttggccagcgactagacacaccccgcaagctgcgcttccccggacgcttcctggacgacatcactgccttggtgggctctgtgggcctggaggtcatcacccgtgtccacaaggatgtggagctggccgagcacctcaacgccagcctggctttcttcctcagtgaccttctgtccctggtggaccggggctttgtcttcagcctggtccgggcccactacaagcaggtggccacgcggctccagtcgtcccctaatccagcagccctgctgaccctgcgcatggaattcacccgcatcctgtgcagccacgagcactacgtgaccctcaacctcccctgctgccccctgtcacctccagcctcgccctccccctctgtgtcctccaccacctcccagagctccaccttctccagccaagccccggaccccaaggtgaccagcatgttcgaactgagtggaccattccggcagcagcacttcctagctgggctcctgctgacggagctggcactggccctcgaacctgaggctgaaggggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctgagggcccaggtcagcggtcaagactggcctcaatgcttgactcagacacagaaggcgaaggggacattgcgggtaccatcaacccctctgtggccatggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggacttgctgtacctttgcctggctgcctttgagtacaaggggaaaaaggcctttgaacgcatcaacagcctcacattcaaaaaatctctggatatgaaggcgcggctagaggaagccattctgggtaccatcggagctcgacaagaaatggttcggcgaagtcgtgagaggagcccgtttgggaatccagagaacgtgcgctggcggaagagcgtcacacactggaagcaaacctcagaccgcgtggacaagaccaaggatgaaatggaacacgaggccttggtggaagggaacctggcaaccgaggcaagcctagtggttctggacacactggagatcatcgtgcagacggtgatgctttcagaagcccgggagagcgtcttgggggcagtgctgaaggttgtgctgtacagcctgggcagtgcccagagtgccctcttcttgcagcatggcctggccacccagagggcccttgtgtccaagttcccggagctgctgttcgaggaggacacggagctgtgtgccgacctgtgcctgaggctcctacgacactgtggcagccgcatcagcaccatccgcacgcacgccagcgcctcgctgtacctgctcatgcgacagaacttcgagatcggccacaactttgcccgtgtgaagatgcaggtcaccatgtctctctcgtccctggtggggacgacgcagaacttcagtgaagagcacctgcgacgttcactcaaaaccatcctcacctatgctgaggaggacatggggctgcgggacagcaccttcgcagagcaggtccaggacctgatgttcaacctgcacatgatcctgacggacacggtgaagatgaaggaacaccaggaggaccctgagatgctcatcgacctcatgtacagaattgcccggggctaccagggctcaccggaccttcggctgacctggttgcagaacatggccgggaagcacgcggagctgggcaaccacgccgaggccgcccagtgcatggtgcacgcggccgccctcgtggctgagtacctcgccctgctcgaggaccaccgccacctgcccgtgggctgcgtttccttccagaacatctcatccaatgtgctagaggagtccgccatctccgacgacatcctgtcgcccgacgaggagggcttctgctccgggaagcacttcactgagctggggctggtagggttgctggaacaggcagccggctacttcaccatgggcgggctctacgaggcggtgaatgaggtctacaagaacctcatccccatcctggaagcccaccgtgactacaagaagctggccgcggtgcacggcaaactgcaggaggccttcaccaagatcatgcaccagagttccggctgggagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggaggctctgcagcccctgcttacccagcgcctgccccagctgatggcacccaccccacccggcctcaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggtttttataagcaa

SEQ ID NO: 459062 - DNA, 8010 bp, Homo sapiens
tgcatcaacgcgttggggagctcttaccatattgtcgacctgcaggcggcgcgaattcactagtgattgagctgaggaggagcagaggccagggacccgtgggcctccctccagacctggaaggccacaggcccagccgggaggggaaggagagtccgtgatggcttcagaccccactggtggcagcattctcatctcctgatctgtgcttgatggggaacgcgttgggggaactggggagctgtgggcccttaaagcctcagcactcctggttctcttggccctcggcctatttatttcgttccacaatctggattttcctcatagaaagaatctgtccgctccgctgcctgagttttcccgtccccaatggccccctccctatctttccaggacggtggccgcagaggtgcggaagcaggtgtcccgggaacgcagtggctccccccactccagcaggcgctgcagcagctccctgggggtcccactgactgaagttgtcgagcccctggactttgaggatgtacttctgagccggccaccagatgctgagcccgggcccctcagggacctggtagaattcccagctgatgacttggagctgctgctgcagccccgggaatgccggaccacggagcccgggatccccaaggatgaaaaactggatgcccaggtgagggccgcggtggagatgtatattgaggactgggtcattgtccacagaaggtatcagtacctgagtgcagcatacagccccgtcaccacagacacacagcgggagcgacagaagggcctcccccgccaggtctttgagcaggatgcttctggagacgagaggtccggccctgaggactcgaatgactcccggcgtggctcgggctccccggaagacacccctcgaagcagtggtgcctctagcatcttcgacctgaggaacctggcagctgactcattgctgccctctctgctagagcgggcggccccagaagatgtggaccggcgcaatgaaacccttcgacggcagcaccggcccccggccctgctcaccctctacccggcacctgacgaggatgaagccgtggaacgctgtagccgcccagagccaccccgcgagcactttggacaaaggatcttggtcaagtgtctgtcgctcaagttcgagattgaaattgagcccatctttgggatcttggctctgtatgatgtgcgggagaaaaagaagatctcggagaacttctacttcgacctgaactcggactccatgaaggggctgcttcgggctcatggcacccaccctgccatctccaccctggcccgctctgccatcttctctgtgacctacccctcacctgacatcttcctggtcatcaagttggagaaggtgcttcagcaaggggacatcagtgagtgctgtgagccttacatggtgttgaaagaagtggacacagccaagaacaaagagaagctagagaagctgcgcctggcggccgagcagttctgcacccgcctgggccgctaccgcatgcccttcgcctggacggccgtgcacttggccaacatcgtgagcagcgctgggcagctggaccgggactctgactcggagggcgagcgccggccagcctggacagaccgccgccgtcgggggccccaggaccgggcgagtagtggggacgacgcctgcagcttctctggcttccgtccagccacgctaactgtcacaaacttctttaagcaggaggctgagcgactcagtgacgaggacctcttcaagttcctggctgacatgaggcgcccgtcgtccctgctgcggcgactacgtcctgtgactgcccagctcaagatcgacatttctccggctcctgaaaatccccacttctgcctctcccctgagctgcttcatatcaagccctacccggaccccaggggccggcccaccaaggagattctggagttccccgcccgcgaagtctatgccccccataccagctacaggaacctgctgtacgtgtacccgcacagcctcaacttcagcagccgccagggctccgtgcgcaaccttgctgtgcgagtgcagtacatgacaggcgaggaccccagccaggctctgccggtcagtggctgtgccccagggaaggggggtagggcatcccccatgggtccctcatgaatccactctcccaggtcatctttggcaagtccagctgcagtgaatttacccgcgaggccttcacaccggtggtctaccataacaagtatgtagggggacacgtgaggaacttgggggcactcatgggggtaggaggatgtcccttatatatacacataaggcagcatcgatgggaagatgggggacaggaagaagagaggtagaggctcccagagtgctaatgagggaagctgaggcagacagcagagacagtggggcctagcagcaataagggcgtggcatggcagaggtgatggggcagacagtggggaccccagcccccagcagatcccccagcccgattctgccaggtcccccgagttctacgaggagttcaagctgcatcttccagcctgcgtgacagagaaccatcacctgctgttcaccttctaccatgtcagctgccagccccggccgggcactgccctggagacacccgtgggctttactgtgagccgtcccctccctccctccccctgagccctcctcgtcccccaacctggccgcagacctgacctccagcctctccccagtggatcccactgctgcagcacgggcgcctgaggaccggccccttctgtctcccagtgtctgtggaccagccgccgcccagctattccgtgctcacacccgatgtatgtgccctggagctcctgcctgccaatgcactgtccccagaagcactcccgagtcacctgccttccttcctgtcaatcctgggaggcttgttatcctctactggtgcctccagggcccccgtgtagctcattattcccctattaatgcctctctgtgtcctacatgtcctccccaaagattcccattgcctctctgctccattcccactttagccaccctgactgccttcctgatcactgtcccctgccctcgtagtaccttatcattccccatgaatgcaccattgttaatgaccctaggcctcaaatcctcctatcctgtttcctgacctactcaatgaatattcattcaccctgtgtctccattctctgcccccgtcttggcatgtggatttccagcctgcccagtggaccctctcagtctactgggaccagggctgggggcagggtgcttggctgcacccccagaccgggctacactcacgctgcagtgtcgcaatggctggggccgctgggtgacctgatcagtcagggagggctgaccagtgcccacctggtgcctccctcccacaggtggcgcttccgggcatgcgctgggtggacggtcacaagggcgtgttcagtgtggagctcacagccgtgtcctctgtgcacccccaggtacggggtgggccgggaaccaagagtcccgccctgctcccctcttgcctgccctacgattgagtaacagttgccgatggccggggaggtctggcctcaggccttggacgtgactttggtcagctggacccagctttaagggaagctgctgattcaggcaggggtggtcttcattccctgaggccccaccctgctcactccacatccctacccaggacccctacctggacaaattcttcaccctggtgcacgtcctggaggagggagccttcccattccggctcaaggacactgtgctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattgtgaacctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaagggcatcgatcgctcacactcctgggtgaattccgcttatgctccaggaggcagtaaggctgtgctgcggcgggcgcccccttattgtggggccgaccccagacagctgcttcacgaggagctggctctgcagtgggtggtcagcagcagtgccgtacgcgaggccatcctccagcacgcctggttcttcttccagctcatggtgaagagtatggcgctgcacctgctgcttggccagcgactagacacaccccgcaagctgcgcttccccggacgcttcctggacgacatcactgccttggtgggctctgtgggcctggaggtcatcacccgtgtccacaaggatgtggagctggccgagcacctcaacgccagcctggctttcttcctcagtgaccttctgtccctggtggaccggggctttgtcttcagcctggtccgggcccactacaagcaggtggccacgcggctccagtcgtcccctaatccagcagccctgctgaccctgcgcatggaattcacccgcatcctgtgcagccacgagcactacgtgaccctcaacctcccctgctgccccctgtcacctccagcctcgccctccccctctgtgtcctccaccacctcccagagctccaccttctccagccaagccccggaccccaaggtgaccagcatgttcgaactgagtggaccattccggcagcagcacttcctagctgggctcctgctgacggagctggcactggccctcgaacctgaggctgaaggggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctgagggcccaggtcagcggtcaagactggcctcaatgcttgactcagacacagaaggcgaaggggacattgcgggtaccatcaacccctctgtggccatggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggacttgctgtacctttgcctggctgcctttgagtacaaggggaaaaaggcctttgaacgcatcaacagcctcacattcaaaaaatctctggatatgaaggcgcggctagaggaagccattctgggtaccatcggagctcgacaagaaatggttcggcgaagtcgtgagaggagcccgtttgggaatccagagaacgtgcgctggcggaagagcgtcacacactggaagcaaacctcagaccgcgtggacaagaccaaggatgaaatggaacacgaggccttggtggaagggaacctggcaaccgaggcaagcctagtggttctggacacactggagatcatcgtgcagacggtgatgctttcagaagcccgggagagcgtcttgggggcagtgctgaaggttgtgctgtacagcctgggcagtgcccagagtgccctcttcttgcagcatggcctggccacccagagggcccttgtgtccaagttcccggagctgctgttcgaggaggacacggagctgtgtgccgacctgtgcctgaggctcctacgacactgtggcagccgcatcagcaccatccgcacgcacgccagcgcctcgctgtacctgctcatgcgacagaacttcgagatcggccacaactttgcccgtgtgaagatgcaggtcaccatgtctctctcgtccctggtggggacgacgcagaacttcagtgaagagcacctgcgacgttcactcaaaaccatcctcacctatgctgaggaggacatggggctgcgggacagcaccttcgcagagcaggtccaggacctgatgttcaacctgcacatgatcctgacggacacggtgaagatgaaggaacaccaggaggaccctgagatgctcatcgacctcatgtacagaattgcccggggctaccagggctcaccggaccttcggctgacctggttgcagaacatggccgggaagcacgcggagctgggcaaccacgccgaggccgcccagtgcatggtgcacgcggccgccctcgtggctgagtacctcgccctgctcgaggaccaccgccacctgcccgtgggctgcgtttccttccagaacatctcatccaatgtgctagaggagtccgccatctccgacgacatcctgtcgcccgacgaggagggcttctgctccgggaagcacttcactgagctggggctggtagggttgctggaacaggcagccggctacttcaccatgggcgggctctacgaggcggtgaatgaggtctacaagaacctcatccccatcctggaagcccaccgtgactacaagaagctggccgcggtgcacggcaaactgcaggaggccttcaccaagatcatgcaccagagttccggctgggagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggaggctctgcagcccctgcttacccagcgcctgccccagctgatggcacccaccccacccggcctcaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggtttttataagcaa

SEQ ID NO: 459063 - DNA, 3336 bp, Homo sapiens
tggcttaggggtgtctctagtagatttcaggatcagcttttcgcctttcttttcaacttcaaaacccacttttttaagtagggatgcatctgccagcccctgttcctccatctttgcaatcagttcatgcagtgccctgatagtcagttcgaatgcccggacttctcccctgctgccccctgtcacctccagcctcgccctccccctctgtgtcctccaccacctcccagagctccaccttctccagccaagccccggaccccaaggtgaccagcatgttcgaactgagtggaccattccggcagcagcacttcctagctgggctcctgctgacggagctggcactggccctcgaacctgaggctgaaggggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctgagggcccaggtcagcggtcaagactggcctcaatgcttgactcagacacagaaggcgaaggggacattgcgggtaccatcaacccctctgtggccatggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggacttgctgtacctttgcctggctgcctttgagtacaaggggaaaaaggcctttgaacgcatcaacagcctcacattcaaaaaatctctggatatgaaggcgcggctagaggaagccattctgggtaccatcggagctcgacaagaaatggttcggcgaagtcgtgagaggagcccgtttgggaatccagagaacgtgcgctggcggaagagcgtcacacactggaagcaaacctcagaccgcgtggacaagaccaaggatgaaatggaacacgaggccttggtggaagggaacctggcaaccgaggcaagcctagtggttctggacacactggagatcatcgtgcagacggtgatgctttcagaagcccgggagagcgtcttgggggcagtgctgaaggttgtgctgtacagcctgggcagtgcccagagtgccctcttcttgcagcatggcctggccacccagagggcccttgtgtccaagttcccggagctgctgttcgaggaggacacggagctgtgtgccgacctgtgcctgaggctcctacgacactgtggcagccgcatcagcaccatccgcacgcacgccagcgcctcgctgtacctgctcatgcgacagaacttcgagatcggccacaactttgcccgtgtgaagatgcaggtcaccatgtctctctcgtccctggtggggacgacgcagaacttcagtgaagagcacctgcgacgttcactcaaaaccatcctcacctatgctgaggaggacatggggctgcgggacagcaccttcgcagagcaggtccaggacctgatgttcaacctgcacatgatcctgacggacacggtgaagatgaaggaacaccaggaggaccctgagatgctcatcgacctcatgtacagaattgcccggggctaccagggctcaccggaccttcggctgacctggttgcagaacatggccgggaagcacgcggagctgggcaaccacgccgaggccgcccagtgcatggtgcacgcggccgccctcgtggctgagtacctcgccctgctcgaggaccaccgccacctgcccgtgggctgcgtttccttccagaacatctcatccaatgtgctagaggagtccgccatctccgacgacatcctgtcgcccgacgaggagggcttctgctccgggaagcacttcactgagctggggctggtagggttgctggaacaggcagccggctacttcaccatgggcgggctctacgaggcggtgaatgaggtctacaagaacctcatccccatcctggaagcccaccgtgactacaagaagctggccgcggtgcacggcaaactgcaggaggccttcaccaagatcatgcaccagagttccggctgggagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggaggctctgcagcccctgcttacccagcgcctgccccagctgatggcacccaccccacccggcctcaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggtttttataagcaa

SEQ ID NO: 459064 - DNA, 6177 bp, Homo sapiens
gacgcgaggaccatggctgcctccgagcgccgcgccttcgcgcacaagatcaacaggacggtggccgcagaggtgcggaagcaggtgtcccgggaacgcagtggctccccccactccagcaggcgctgcagcagctccctgggggtcccactgactgaagttgtcgagcccctggactttgaggatgtacttctgagccggccaccagatgctgagcccgggcccctcagggacctggtagaattcccagctgatgacttggagctgctgctgcagccccgggaatgccggaccacggagcccgggatccccaaggatgaaaaactggatgcccaggtgagggccgcggtggagatgtatattgaggactgggtcattgtccacagaaggtatcagtacctgagtgcagcatacagccccgtcaccacagacacacagcgggagcgacagaagggcctcccccgccaggtctttgagcaggatgcttctggagacgagaggtccggccctgaggactcgaatgactcccggcgtggctcgggctccccggaagacacccctcgaagcagtggtgcctctagcatcttcgacctgaggaacctggcagctgactcattgctgccctctctgctagagcgggcggccccagaagatgtggaccggcgcaatgaaacccttcgacggcagcaccggcccccggccctgctcaccctctacccggcacctgacgaggatgaagccgtggaacgctgtagccgcccagagccaccccgcgagcactttggacaaaggatcttggtcaagtgtctgtcgctcaagttcgagattgaaattgagcccatctttgggatcttggctctgtatgatgtgcgggagaaaaagaagatctcggagaacttctacttcgacctgaactcggactccatgaaggggctgcttcgggctcatggcacccaccctgccatctccaccctggcccgctctgccatcttctctgtgacctacccctcacctgacatcttcctggtcatcaagttggagaaggtgcttcagcaaggggacatcagtgagtgctgtgagccttacatggtgttgaaagaagtggacacagccaagaacaaagagaagctagagaagctgcgcctggcggccgagcagttctgcacccgcctgggccgctaccgcatgcccttcgcctggacggccgtgcacttggccaacatcgtgagcagcgctgggcagctggaccgggactctgactcggagggcgagcgccggccagcctggacagaccgccgccgtcgggggccccaggaccgggcgagtagtggggacgacgcctgcagcttctctggcttccgtccagccacgctaactgtcacaaacttctttaagcaggaggctgagcgactcagtgacgaggacctcttcaagttcctggctgacatgaggcgcccgtcgtccctgctgcggcgactacgtcctgtgactgcccagctcaagatcgacatttctccggctcctgaaaatccccacttctgcctctcccctgagctgcttcatatcaagccctacccggaccccaggggccggcccaccaaggagattctggagttccccgcccgcgaagtctatgccccccataccagctacaggaacctgctgtacgtgtacccgcacagcctcaacttcagcagccgccagggctccgtgcgcaaccttgctgtgcgagtgcagtacatgacaggcgaggaccccagccaggctctgccggtcatctttggcaagtccagctgcagtgaatttacccgcgaggccttcacaccggtggtctaccataacaagtcccccgagttctacgaggagttcaagctgcatcttccagcctgcgtgacagagaaccatcacctgctgttcaccttctaccatgtcagctgccagccccggccgggcactgccctggagacacccgtgggctttacttggatcccactgctgcagcacgggcgcctgaggaccggccccttctgtctcccagtgtctgtggaccagccgccgcccagctattccgtgctcacacccgatgtggcgcttccgggcatgcgctgggtggacggtcacaagggcgtgttcagtgtggagctcacagccgtgtcctctgtgcacccccaggacccctacctggacaaattcttcaccctggtgcacgtcctggaggagggagccttcccattccggctcaaggacactgtgctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattgtgaacctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaagctgcttcacgaggagctggctctgcagtgggtggtcagcagcagtgccgtacgcgaggccatcctccagcacgcctggttcttcttccagctcatggtgaagagtatggcgctgcacctgctgcttggccagcgactagacacaccccgcaagctgcgcttccccggacgcttcctggacgacatcactgccttggtgggctctgtgggcctggaggtcatcacccgtgtccacaaggatgtggagctggccgagcacctcaacgccagcctggctttcttcctcagtgaccttctgtccctggtggaccggggctttgtcttcagcctggtccgggcccactacaagcaggtggccacgcggctccagtcgtcccctaatccagcagccctgctgaccctgcgcatggaattcacccgcatcctgtgcagccacgagcactacgtgaccctcaacctcccctgctgccccctgtcacctccagcctcgccctccccctctgtgtcctccaccacctcccagagctccaccttctccagccaagccccggaccccaaggtgaccagcatgttcgaactgagtggaccattccggcagcagcacttcctagctgggctcctgctgacggagctggcactggccctcgaacctgaggctgaaggggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctgagggcccaggtcagcggtcaagactggcctcaatgcttgactcagacacagaaggcgaaggggacattgcgggtaccatcaacccctctgtggccatggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggacttgctgtacctttgcctggctgcctttgagtacaaggggaaaaaggcctttgaacgcatcaacagcctcacattcaaaaaatctctggatatgaaggcgcggctagaggaagccattctgggtaccatcggagctcgacaagaaatggttcggcgaagtcgtgagaggagcccgtttgggaatccagagaacgtgcgctggcggaagagcgtcacacactggaagcaaacctcagaccgcgtggacaagaccaaggatgaaatggaacacgaggccttggtggaagggaacctggcaaccgaggcaagcctagtggttctggacacactggagatcatcgtgcagacggtgatgctttcagaagcccgggagagcgtcttgggggcagtgctgaaggttgtgctgtacagcctgggcagtgcccagagtgccctcttcttgcagcatggcctggccacccagagggcccttgtgtccaagttcccggagctgctgttcgaggaggacacggagctgtgtgccgacctgtgcctgaggctcctacgacactgtggcagccgcatcagcaccatccgcacgcacgccagcgcctcgctgtacctgctcatgcgacagaacttcgagatcggccacaactttgcccgtgtgaagatgcaggtcaccatgtctctctcgtccctggtggggacgacgcagaacttcagtgaagagcacctgcgacgttcactcaaaaccatcctcacctatgctgaggaggacatggggctgcgggacagcaccttcgcagagcaggtccaggacctgatgttcaacctgcacatgatcctgacggacacggtgaagatgaaggaacaccaggaggaccctgagatgctcatcgacctcatgtacagaattgcccggggctaccagggctcaccggaccttcggctgacctggttgcagaacatggccgggaagcacgcggagctgggcaaccacgccgaggccgcccagtgcatggtgcacgcggccgccctcgtggctgagtacctcgccctgctcgaggaccaccgccacctgcccgtgggctgcgtttccttccagaacatctcatccaatgtgctagaggagtccgccatctccgacgacatcctgtcgcccgacgaggagggcttctgctccgggaagcacttcactgagctggggctggtagggttgctggaacaggcagccggctacttcaccatgggcgggctctacgaggcggtgaatgaggtctacaagaacctcatccccatcctggaagcccaccgtgactacaagaagctggccgcggtgcacggcaaactgcaggaggccttcaccaagatcatgcaccagagttccggctgggagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggacagcaccttcgcagagcaggtccaggacctgatgttcaacctgcacatgatcctgacggacacggtgaagatgaaggaacaccaggatgagcctgagatgttcatcgacctcattacagcactgcccagg

SEQ ID NO: 459065 - DNA, 1259 bp, Homo sapiens
catgtctgccccatcctccccggatcggccttgagttccggctgggagcgcgtgttcgggacgtatttccgcgtgggcttctacggcgcccacttcggtgacctggatgagcaggagtttgtgtacaaggagccatcgatcacgaagctggcagagatctcacaccggctggaggcacgtccttgtggttgggggtggaacggggcatggggctgccttggggctggagtaggggctgtccctgggtggccccgagtcagccctgtgtctccaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggaggctctgcagcccctgcttacccagcgcctgccccagctgatggcacccaccccacccggcctcaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggtttttataagcaa

SEQ ID NO: 459066 - DNA, 7998 bp, Homo sapiens
tgcatcaacgcgttggggagctcttaccatattgtcgacctgcaggcggcgcgaattcactagtgattgagctgaggaggagcagaggccagggacccgtgggcctccctccagacctggaaggccacaggcccagccgggaggggaaggagagtccgtgatggcttcagaccccactggtggcagcattctcatctcctgatctgtgcttgatggggaacgcgttgggggaactggggagctgtgggcccttaaagcctcagcactcctggttctcttggccctcggcctatttatttcgttccacaatctggattttcctcatagaaagaatctgtccgctccgctgcctgagttttcccgtccccaatggccccctccctatctttccaggacggtggccgcagaggtgcggaagcaggtgtcccgggaacgcagtggctccccccactccagcaggcgctgcagcagctccctgggggtcccactgactgaagttgtcgagcccctggactttgaggatgtacttctgagccggccaccagatgctgagcccgggcccctcagggacctggtagaattcccagctgatgacttggagctgctgctgcagccccgggaatgccggaccacggagcccgggatccccaaggatgaaaaactggatgcccaggtgagggccgcggtggagatgtatattgaggactgggtcattgtccacagaaggtatcagtacctgagtgcagcatacagccccgtcaccacagacacacagcgggagcgacagaagggcctcccccgccaggtctttgagcaggatgcttctggagacgagaggtccggccctgaggactcgaatgactcccggcgtggctcgggctccccggaagacacccctcgaagcagtggtgcctctagcatcttcgacctgaggaacctggcagctgactcattgctgccctctctgctagagcgggcggccccagaagatgtggaccggcgcaatgaaacccttcgacggcagcaccggcccccggccctgctcaccctctacccggcacctgacgaggatgaagccgtggaacgctgtagccgcccagagccaccccgcgagcactttggacaaaggatcttggtcaagtgtctgtcgctcaagttcgagattgaaattgagcccatctttgggatcttggctctgtatgatgtgcgggagaaaaagaagatctcggagaacttctacttcgacctgaactcggactccatgaaggggctgcttcgggctcatggcacccaccctgccatctccaccctggcccgctctgccatcttctctgtgacctacccctcacctgacatcttcctggtcatcaagttggagaaggtgcttcagcaaggggacatcagtgagtgctgtgagccttacatggtgttgaaagaagtggacacagccaagaacaaagagaagctagagaagctgcgcctggcggccgagcagttctgcacccgcctgggccgctaccgcatgcccttcgcctggacggccgtgcacttggccaacatcgtgagcagcgctgggcagctggaccgggactctgactcggagggcgagcgccggccagcctggacagaccgccgccgtcgggggccccaggaccgggcgagtagtggggacgacgcctgcagcttctctggcttccgtccagccacgctaactgtcacaaacttctttaagcaggaggctgagcgactcagtgacgaggacctcttcaagttcctggctgacatgaggcgcccgtcgtccctgctgcggcgactacgtcctgtgactgcccagctcaagatcgacatttctccggctcctgaaaatccccacttctgcctctcccctgagctgcttcatatcaagccctacccggaccccaggggccggcccaccaaggagattctggagttccccgcccgcgaagtctatgccccccataccagctacaggaacctgctgtacgtgtacccgcacagcctcaacttcagcagccgccagggctccgtgcgcaaccttgctgtgcgagtgcagtacatgacaggcgaggaccccagccaggctctgccggtcagtggctgtgccccagggaaggggggtagggcatcccccatgggtccctcatgaatccactctcccaggtcatctttggcaagtccagctgcagtgaatttacccgcgaggccttcacaccggtggtctaccataacaagtatgtagggggacacgtgaggaacttgggggcactcatgggggtaggaggatgtcccttatatatacacataaggcagcatcgatgggaagatgggggacaggaagaagagaggtagaggctcccagagtgctaatgagggaagctgaggcagacagcagagacagtggggcctagcagcaataagggcgtggcatggcagaggtgatggggcagacagtggggaccccagcccccagcagatcccccagcccgattctgccaggtcccccgagttctacgaggagttcaagctgcatcttccagcctgcgtgacagagaaccatcacctgctgttcaccttctaccatgtcagctgccagccccggccgggcactgccctggagacacccgtgggctttactgtgagccgtcccctccctccctccccctgagccctcctcgtcccccaacctggccgcagacctgacctccagcctctccccagtggatcccactgctgcagcacgggcgcctgaggaccggccccttctgtctcccagtgtctgtggaccagccgccgcccagctattccgtgctcacacccgatgtatgtgccctggagctcctgcctgccaatgcactgtccccagaagcactcccgagtcacctgccttccttcctgtcaatcctgggaggcttgttatcctctactggtgcctccagggcccccgtgtagctcattattcccctattaatgcctctctgtgtcctacatgtcctccccaaagattcccattgcctctctgctccattcccactttagccaccctgactgccttcctgatcactgtcccctgccctcgtagtaccttatcattccccatgaatgcaccattgttaatgaccctaggcctcaaatcctcctatcctgtttcctgacctactcaatgaatattcattcaccctgtgtctccattctctgcccccgtcttggcatgtggatttccagcctgcccagtggaccctctcagtctactgggaccagggctgggggcagggtgcttggctgcacccccagaccgggctacactcacgctgcagtgtcgcaatggctggggccgctgggtgacctgatcagtcagggagggctgaccagtgcccacctggtgcctccctcccacaggtggcgcttccgggcatgcgctgggtggacggtcacaagggcgtgttcagtgtggagctcacagccgtgtcctctgtgcacccccaggtacggggtgggccgggaaccaagagtcccgccctgctcccctcttgcctgccctacgattgagtaacagttgccgatggccggggaggtctggcctcaggccttggacgtgactttggtcagctggacccagctttaagggaagctgctgattcaggcaggggtggtcttcattccctgaggccccaccctgctcactccacatccctacccaggacccctacctggacaaattcttcaccctggtgcacgtcctggaggagggagccttcccattccggctcaaggacactgtgctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattgtgaacctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaaggccatcgactgcaactctagccgagcctcctcctacctcgagggttcctcctcggccccaccagccacccagctgagacccactgtgcagaagctgcttcacgaggagctggctctgcagtgggtggtcagcagcagtgccgtacgcgaggccatcctccagcacgcctggttcttcttccagctcatggtgaagagtatggcgctgcacctgctgcttggccagcgactagacacaccccgcaagctgcgcttccccggacgcttcctggacgacatcactgccttggtgggctctgtgggcctggaggtcatcacccgtgtccacaaggatgtggagctggccgagcacctcaacgccagcctggctttcttcctcagtgaccttctgtccctggtggaccggggctttgtcttcagcctggtccgggcccactacaagcaggtggccacgcggctccagtcgtcccctaatccagcagccctgctgaccctgcgcatggaattcacccgcatcctgtgcagccacgagcactacgtgaccctcaacctcccctgctgccccctgtcacctccagcctcgccctccccctctgtgtcctccaccacctcccagagctccaccttctccagccaagccccggaccccaaggtgaccagcatgttcgaactgagtggaccattccggcagcagcacttcctagctgggctcctgctgacggagctggcactggccctcgaacctgaggctgaaggggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctgagggcccaggtcagcggtcaagactggcctcaatgcttgactcagacacagaaggcgaaggggacattgcgggtaccatcaacccctctgtggccatggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggacttgctgtacctttgcctggctgcctttgagtacaaggggaaaaaggcctttgaacgcatcaacagcctcacattcaaaaaatctctggatatgaaggcgcggctagaggaagccattctgggtaccatcggagctcgacaagaaatggttcggcgaagtcgtgagaggagcccgtttgggaatccagagaacgtgcgctggcggaagagcgtcacacactggaagcaaacctcagaccgcgtggacaagaccaaggatgaaatggaacacgaggccttggtggaagggaacctggcaaccgaggcaagcctagtggttctggacacactggagatcatcgtgcagacggtgatgctttcagaagcccgggagagcgtcttgggggcagtgctgaaggttgtgctgtacagcctgggcagtgcccagagtgccctcttcttgcagcatggcctggccacccagagggcccttgtgtccaagttcccggagctgctgttcgaggaggacacggagctgtgtgccgacctgtgcctgaggctcctacgacactgtggcagccgcatcagcaccatccgcacgcacgccagcgcctcgctgtacctgctcatgcgacagaacttcgagatcggccacaactttgcccgtgtgaagatgcaggtcaccatgtctctctcgtccctggtggggacgacgcagaacttcagtgaagagcacctgcgacgttcactcaaaaccatcctcacctatgctgaggaggacatggggctgcgggacagcaccttcgcagagcaggtccaggacctgatgttcaacctgcacatgatcctgacggacacggtgaagatgaaggaacaccaggaggaccctgagatgctcatcgacctcatgtacagaattgcccggggctaccagggctcaccggaccttcggctgacctggttgcagaacatggccgggaagcacgcggagctgggcaaccacgccgaggccgcccagtgcatggtgcacgcggccgccctcgtggctgagtacctcgccctgctcgaggaccaccgccacctgcccgtgggctgcgtttccttccagaacatctcatccaatgtgctagaggagtccgccatctccgacgacatcctgtcgcccgacgaggagggcttctgctccgggaagcacttcactgagctggggctggtagggttgctggaacaggcagccggctacttcaccatgggcgggctctacgaggcggtgaatgaggtctacaagaacctcatccccatcctggaagcccaccgtgactacaagaagctggccgcggtgcacggcaaactgcaggaggccttcaccaagatcatgcaccagagttccggctgggagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggaggctctgcagcccctgcttacccagcgcctgccccagctgatggcacccaccccacccggcctcaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggtttttataagcaa

SEQ ID NO: 459067 - DNA, 6623 bp, Homo sapiens
ggtgcaattattgtcattgttgttatttatcatcatcagtatcattacaaaggctcagctggaaggcctgaagtgcccattatacacatagggaaactgaggcccagagaggggtcaaggcttgcacagagttgcccctgggggaaggaggcaggactcggactctggcctcagtttccccacctgagaaacaggccacataactctagtgacctcctgggggaagggcagtcaggcccttgggtggggcttaggcttgaccactggccacctgaggtaccttggaactctggccctgagtgcctcgctattctctgccttctgtgtgtcactgtgccccatgagtgcctccaatgtccttctgtattcccaccctctaccacactgttcccaatctgtgtttttagggtgctcgcttgtcccccaccctctgccctctgtcctatctcctgactgatacctgtattacctctcaccgggccctcaatgccccagcctcatgacctactcttcctggactgtctgtgctcccagccagccttgtcccatcaccccagccttgtatgtgcaccttcagggcccctgtccctctgacacccccatcctgccccccacaggaacctgctgtacgtgtacccgcacagcctcaacttcagcagccgccagggctccgtgcgcaaccttgctgtgcgagtgcagtacatgacaggcgaggaccccagccaggctctgccggtcagtggctgtgccccagggaaggggggtagggcatcccccatgggtccctcatgaatccactctcccaggtcatctttggcaagtccagctgcagtgaatttacccgcgaggccttcacaccggtggtctaccataacaagtatgtagggggacacgtgaggaacttgggggcactcatgggggtaggaggatgtcccttatatatacacataaggcagcatcgatgggaagatgggggacaggaagaagagaggtagaggctcccagagtgctaatgagggaagctgaggcagacagcagagacagtggggcctagcagcaataagggcgtggcatggcagaggtgatggggcagacagtggggaccccagcccccagcagatcccccagcccgattctgccaggtcccccgagttctacgaggagttcaagctgcatcttccagcctgcgtgacagagaaccatcacctgctgttcaccttctaccatgtcagctgccagccccggccgggcactgccctggagacacccgtgggctttactgtgagccgtcccctccctccctccccctgagccctcctcgtcccccaacctggccgcagacctgacctccagcctctccccagtggatcccactgctgcagcacgggcgcctgaggaccggccccttctgtctcccagtgtctgtggaccagccgccgcccagctattccgtgctcacacccgatgtatgtgccctggagctcctgcctgccaatgcactgtccccagaagcactcccgagtcacctgccttccttcctgtcaatcctgggaggcttgttatcctctactggtgcctccagggcccccgtgtagctcattattcccctattaatgcctctctgtgtcctacatgtcctccccaaagattcccattgcctctctgctccattcccactttagccaccctgactgccttcctgatcactgtcccctgccctcgtagtaccttatcattccccatgaatgcaccattgttaatgaccctaggcctcaaatcctcctatcctgtttcctgacctactcaatgaatattcattcaccctgtgtctccattctctgcccccgtcttggcatgtggatttccagcctgcccagtggaccctctcagtctactgggaccagggctgggggcagggtgcttggctgcacccccagaccgggctacactcacgctgcagtgtcgcaatggctggggccgctgggtgacctgatcagtcagggagggctgaccagtgcccacctggtgcctccctcccacaggtggcgcttccgggcatgcgctgggtggacggtcacaagggcgtgttcagtgtggagctcacagccgtgtcctctgtgcacccccaggtacggggtgggccgggaaccaagagtcccgccctgctcccctcttgcctgccctacgattgagtaacagttgccgatggccggggaggtctggcctcaggccttggacgtgactttggtcagctggacccagctttaagggaagctgctgattcaggcaggggtggtcttcattccctgaggccccaccctgctcactccacatccctacccaggacccctacctggacaaattcttcaccctggtgcacgtcctggaggagggagccttcccattccggctcaaggacactgtgctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattgtgaacctgggccgtggagcctttgaagcaatggcccatgtagtcagccttgttcaccggagcctggaggcagcccaggatgcccgcggtcactgcccacagctggctgcctacgtccactacgcctttcgccttcctggcactgagcccagcctcccggatggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaaggccatcgactgcaactctagccgagcctcctcctacctcgagggttcctcctcggccccaccagccacccagctgagacccactgtgcagaagctgcttcacgaggagctggctctgcagtgggtggtcagcagcagtgccgtacgcgaggccatcctccagcacgcctggttcttcttccagctcatggtgaagagtatggcgctgcacctgctgcttggccagcgactagacacaccccgcaagctgcgcttccccggacgcttcctggacgacatcactgccttggtgggctctgtgggcctggaggtcatcacccgtgtccacaaggatgtggagctggccgagcacctcaacgccagcctggctttcttcctcagtgaccttctgtccctggtggaccggggctttgtcttcagcctggtccgggcccactacaagcaggtggccacgcggctccagtcgtcccctaatccagcagccctgctgaccctgcgcatggaattcacccgcatcctgtgcagccacgagcactacgtgaccctcaacctcccctgctgccccctgtcacctccagcctcgccctccccctctgtgtcctccaccacctcccagagctccaccttctccagccaagccccggaccccaaggtgaccagcatgttcgaactgagtggaccattccggcagcagcacttcctagctgggctcctgctgacggagctggcactggccctcgaacctgaggctgaaggggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctgagggcccaggtcagcggtcaagactggcctcaatgcttgactcagacacagaaggcgaaggggacattgcgggtaccatcaacccctctgtggccatggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggacttgctgtacctttgcctggctgcctttgagtacaaggggaaaaaggcctttgaacgcatcaacagcctcacattcaaaaaatctctggatatgaaggcgcggctagaggaagccattctgggtaccatcggagctcgacaagaaatggttcggcgaagtcgtgagaggagcccgtttgggaatccagagaacgtgcgctggcggaagagcgtcacacactggaagcaaacctcagaccgcgtggacaagaccaaggatgaaatggaacacgaggccttggtggaagggaacctggcaaccgaggcaagcctagtggttctggacacactggagatcatcgtgcagacggtgatgctttcagaagcccgggagagcgtcttgggggcagtgctgaaggttgtgctgtacagcctgggcagtgcccagagtgccctcttcttgcagcatggcctggccacccagagggcccttgtgtccaagttcccggagctgctgttcgaggaggacacggagctgtgtgccgacctgtgcctgaggctcctacgacactgtggcagccgcatcagcaccatccgcacgcacgccagcgcctcgctgtacctgctcatgcgacagaacttcgagatcggccacaactttgcccgtgtgaagatgcaggtcaccatgtctctctcgtccctggtggggacgacgcagaacttcagtgaagagcacctgcgacgttcactcaaaaccatcctcacctatgctgaggaggacatggggctgcgggacagcaccttcgcagagcaggtccaggacctgatgttcaacctgcacatgatcctgacggacacggtgaagatgaaggaacaccaggaggaccctgagatgctcatcgacctcatgtacagaattgcccggggctaccagggctcaccggaccttcggctgacctggttgcagaacatggccgggaagcacgcggagctgggcaaccacgccgaggccgcccagtgcatggtgcacgcggccgccctcgtggctgagtacctcgccctgctcgaggaccaccgccacctgcccgtgggctgcgtttccttccagaacatctcatccaatgtgctagaggagtccgccatctccgacgacatcctgtcgcccgacgaggagggcttctgctccgggaagcacttcactgagctggggctggtagggttgctggaacaggcagccggctacttcaccatgggcgggctctacgaggcggtgaatgaggtctacaagaacctcatccccatcctggaagcccaccgtgactacaagaagctggccgcggtgcacggcaaactgcaggaggccttcaccaagatcatgcaccagagttccggctgggagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggaggctctgcagcccctgcttacccagcgcctgccccagctgatggcacccaccccacccggcctcaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggtttttataagcaa

SEQ ID NO: 459068 - DNA, 3182 bp, Homo sapiens
caagatggctttaatggtgacctgccacctctgacccttgaccgctggcatcccccatttttcccccactctgcagagctccaccttctccagccaagccccggaccccaaggtgaccagcatgttcgaactgagtggaccattccggcagcagcacttcctagctgggctcctgctgacggagctggcactggccctcgaacctgaggctgaaggggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctgagggcccaggtcagcggtcaagactggcctcaatgcttgactcagacacagaaggcgaaggggacattgcgggtaccatcaacccctctgtggccatggccattgctggtggccccctagcccctggctcccgggccagcatctcccaggggccaccaacggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggacttgctgtacctttgcctggctgcctttgagtacaaggggaaaaaggcctttgaacgcatcaacagcctcacattcaaaaaatctctggatatgaaggcgcggctagaggaagccattctgggtaccatcggagctcgacaagaaatggttcggcgaagtcgtgagaggagcccgtttgggaatccagagaacgtgcgctggcggaagagcgtcacacactggaagcaaacctcagaccgcgtggacaagaccaaggatgaaatggaacacgaggccttggtggaagggaacctggcaaccgaggcaagcctagtggttctggacacactggagatcatcgtgcagacggtgatgctttcagaagcccgggagagcgtcttgggggcagtgctgaaggttgtgctgtacagcctgggcagtgcccagagtgccctcttcttgcagcatggcctggccacccagagggcccttgtgtccaagttcccggagctgctgttcgaggaggacacggagctgtgtgccgacctgtgcctgaggctcctacgacactgtggcagccgcatcagcaccatccgcacgcacgccagcgcctcgctgtacctgctcatgcgacagaacttcgagatcggccacaactttgcccgtgtgaagatgcaggtcaccatgtctctctcgtccctggtggggacgacgcagaacttcagtgaagagcacctgcgacgttcactcaaaaccatcctcacctatgctgaggaggacatggggctgcgggacagcaccttcgcagagcaggtccaggacctgatgttcaacctgcacatgatcctgacggacacggtgaagatgaaggaacaccaggaggaccctgagatgctcatcgacctcatgtacagaattgcccggggctaccagggctcaccggaccttcggctgacctggttgcagaacatggccgggaagcacgcggagctgggcaaccacgccgaggccgcccagtgcatggtgcacgcggccgccctcgtggctgagtacctcgccctgctcgaggaccaccgccacctgcccgtgggctgcgtttccttccagaacatctcatccaatgtgctagaggagtccgccatctccgacgacatcctgtcgcccgacgaggagggcttctgctccgggaagcacttcactgagctggggctggtagggttgctggaacaggcagccggctacttcaccatgggcgggctctacgaggcggtgaatgaggtctacaagaacctcatccccatcctggaagcccaccgtgactacaagaagctggccgcggtgcacggcaaactgcaggaggccttcaccaagatcatgcaccagagttccggctgggagcgcgtgttcgggacgtatttccgcgtgggcttctacggcgcccacttcggtgacctggatgagcaggagtttgtgtacaaggagccatcgatcacgaagctggcagagatctcacaccggctggaggagttctacacggagagatttggcgacgacgtcgttgagattatcaaagactctaaccctgtggacaagtccaagcttgactcacaaaaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggagacggtgctgacgccagtggaggtggccatcgaggacatgcagaagaagacacgggagctggcctttgccaccgagcaggacccaccagatgctaagatgctacagatggtgcttcagggctctgtagggcccaccgtgaaccagggtcccctggaggtggcccaggtgtttttagcagagatcccggaagaccccaagctcttccggcatcacaacaaattgcggctctgcttcaaggacttctgcaagaaatgtgaggatgcgctgcggaaaaataaggccctgattgggccggaccagaaggagtaccaccgtgagctggagcgcaactactgccgcctgcgggaggctctgcagcccctgcttacccagcgcctgccccagctgatggcacccaccccacccggcctcaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggtttttataagcaa

SEQ ID NO: 459069 - DNA, 804 bp, Homo sapiens
tgcatcaacgcgttggggagctcttaccatattgtcgacctgcaggcggcgcgaattcactagtgattgagctgaggaggagcagaggccagggacccgtgggcctccctccagacctggaaggccacaggcccagccgggaggggaaggagagtccgtgatggcttcagaccccactggtggcagcattctcatctcctgatctgtgcttgatggggaacgcgttgggggaactggggagctgtgggcccttaaagcctcagcactcctggttctcttggccctcggcctatttatttcgttccacaatctggattttcctcatagaaagaatctgtccgctccgctgcctgagttttcccgtccccaatggccccctccctatctttccaggacggtggccgcagaggtgcggaagcaggtgtcccgggaacgcagtggctccccccactccagcaggcgctgcagcagctccctgggggtcccactgactgaagttgtcgagcccctggactttgaggatgtacttctgagccggccaccagatgctgagcccgggcccctcagggacctggtagaattcccagctgatgacttggagctgctgctgcagccccgggaatgccggaccacggagcccgggatccccaaggatgaaaaactggatgcccaggtgagggccgcggtggagatgtatattgaggactgggtcattgtccacagaaggtgagtctgacttaggggcagctcagggggttcggaacccaaaagggctgagctgatgtctgcagccggtcctactgt

SEQ ID NO: 459070 - DNA, 1343 bp, Homo sapiens
gtgccgtacttaccattatagctttattataccaaaaaggtacaaattagaaccagccaaaaggagagatgcatagagcaaggtctgggagggtctcaaatgcgaagcctcgtttgtcctcaggaccacgtccccccgtggcacactgatgcatgacagtatgacaggttattgctagccaggaagctcacctgaacttcagtgtccagagttcttatcattggggttctgttacttaggcatgaatgactgaatcattgtcatgtggtagagctcagcctccagtcccccctcctccccagaggtgaggctgatagcacgtggctcagagcaccagtgctaaccccggggcagagaggccagcctgccttgagtcatgttgttagataaactcaaggggttcaccaagagtcacctcattagcataatctctcaaacgagggctgaggggcccccatgaatagcagacacttccagtcacttgggaaattccaagggtttagagttggctcctaggcactggggacaaaggcaggctgctacacagttggagtggcgcacgtgaggtggagggaagctgcttttgtagctcccctagggactgtgggaggagttgttaaaatccgatctaaagcatatcggaatgagtgagcttccttgattacatcgccagtcgaacatggggacggcagaggagtgagaatgtgccggggaggagatccctcggcccagagctccccaccatgggttaggaacagtaagtcctggggctctgcatcctcctgccctcctggctgtgggtgagggcacggtgtttcctgatctctcctgctgtgtctccaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatga

SEQ ID NO: 459071 - DNA, 4461 bp, Homo sapiens
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgccacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatga

SEQ ID NO: 459072 - DNA, 4986 bp, Homo sapiens
  misc_feature (4876)..(4876): n is a, c, g, or t
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgccacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatgaaaaaaaaaataaaaaaaaaaaaaaaaagaggggcggggccggccataagaagttatcccccttggaggggccccaaaggtttatgcggcgagttcccccaggctttttcttttgtctccaaagggggggccccatatatatggggagaggctcggatatatatatataagcctaaggcaccggtgggccggctcgttttaacaacacgggtcgggtggccacgcggaaacaaaccgtggctataacctgggggaaatctcttgggggggaacggggcacccctataaccttctcgtggggggggtgggcaaccaatatagtgtgggcacaactctctaccctatacgcgagggagattttttaaaaggcctcaagcgacacatttattcaatatttttcaagggtggtacaatangtcgtgttaaaccactaacgctgatattattgcttggcgtgattgggagaaagtttggggcctcacgggaagtatagtgtacttttgggacacaatttttttttcccgga

SEQ ID NO: 459073 - DNA, 4551 bp, Homo sapiens
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgccacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtagagtggtggatgagcaggatgttgggatgaggggagggtcgagaggaaaggagggctccctcctggtgcctccgtctcctgccctaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatga

SEQ ID NO: 459074 - DNA, 4861 bp, Homo sapiens
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgccacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaaggtattgaggccaccatgttacgaactgacccttccatgccacgcacttctctgatgcgaagccggctggagggtggagggtgggtaggggactgggttggagaagatttcctggggaccatggggcaaatggggcagcctgcagctctgggactcggggacaaaggactctgctctgggtgaggttttgtttcattatttctttgaggctgaagtacagggcccagggaggcactgtgccctcttgtagaggcctcgcagtcaggcccatgtggaggtgtggtggccctcaaagtccatggctccattccagagcagtgcctgggccactgggctcccaggagatgcccggcctgcgcttctagtacctccctctgactgtgtccccactgctgttgcagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatga

SEQ ID NO: 459075 - DNA, 3711 bp, Homo sapiens
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggaccaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgccacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatga

SEQ ID NO: 459076 - DNA, 4280 bp, Homo sapiens
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgccacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatga

SEQ ID NO: 459077 - DNA, 2244 bp, Homo sapiens
tggctccattgcttcagtcttcatgattggtaagaattgaataggcccatttgtcagctttggcttgtgtttcctcgggggtggtgctgatgggactgggggacaggagccaagggtccccaccatgggggcctccgagccgcctcttctctcaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatga

SEQ ID NO: 459078 - DNA, 4331 bp, Homo sapiens
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgccacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggtgaggattctgtgctcttcgcaggggtgctgtttgcctgtggggtcggtgttccctccgcttggtattgaagacttgcggtcatccaacccacttacttctctctgcaaacataaaggctgtgatccagcaggctgggtctgtctgattccccaccacccactccagttgtttggtaggctgagcctttaaaaacaaaaccaaaaaactcattattgaaaagtccaaatattcatgaaagtgggaaaaacagtacaacaggccaccatgaattcgttgccttgcctctataattgtcaacgtttgttcaatttcactattcctaccccactccacacacatccattttttttttctggaatattttaaagcttatctcatacattattcatccataaatacttgagtatgtgtctctgactaaaaggacttaaaattttaaatataacctctgtgccgttatcactcataaaaaaatgaatacttaatgtc

SEQ ID NO: 459079 - DNA, 3889 bp, Homo sapiens
  misc_feature (3855)..(3855): n is a, c, g, or t
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgccacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtagagtggtggatgagcaggatgttgggatgaggggagggtcgagaggaaaggagggctccctcctggtgcctccgtctcctgccctaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctgaaaaaaaaccccaaaaacctgttgatcccaatacactatcctatacacatataccattgctttaacanacattcaagccgacagggagcgagctcgatgtaa

SEQ ID NO: 459080 - DNA, 558 bp, Homo sapiens
gtatttgggctgtcgtgcggcgaggggtcatgggctccccttgcttctttcctggcctggagtagtagatcttcgtagacctgacactgcccagtgggctgcgcttctcctgctcctgccgccgggcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatga

SEQ ID NO: 459081 - DNA, 1102 bp, Homo sapiens
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggaataatactatcgtgttcattatagctactctcataagcctcaaaaccatccctcttaggcgaatatgtgcctatggccatactagtcttgcgcctgggaagcagggggggctaggcttactagtctcaatctccaagcatatggctaaatacggtcataccaaacttatccaggtaaatatcggcccatttttacccggtgttccaaatatggtcaacccaggtatttgtccctattgcacacacactttgcccctttcgccaacccttt

SEQ ID NO: 459082 - DNA, 284 bp, Homo sapiens
aggttcctgaggcctctggttgcagttcagactcgggttgtagttcatgctgttcttgctctgctgagggtggcttggggttttctgggcagtggctccattgcttcagtcttcatgattggtaagaattgaataggcccatttgtcagctttggcttgtgtttcctcgggggtggtgctgatgggactgggggacaggagccaagggtccccaccatgggggcctccgagccgcctcttctctcaggtagtggctcggcgctcagacctgaagctcatcgtca

SEQ ID NO: 459083 - DNA, 422 bp, Homo sapiens
cttctcttcataagtcttactaggcccacagatagaagttaggagtcccctctatcaagtccttaggcccgacagctgcggggcctggtgttgggagagctggaggcttgaggattggaatgtggctcggtgccaccagcactctgggggagtttaccacctgcggggtgaagcctgctctcccgtgggattgattttccattgctcgcagtcatgtggcaggatggagcagactgacctttttccttttcaggctcagcacaaacactgggaactggcggggaccaaactgggagatataatgggcgtcaagaaggaggaagagccagataaagctgtgacggaggatgggaaggtggactacaggtgggcagcctcagccagcagcacatcagccttgctccaaagatgggggcccatgt

SEQ ID NO: 459084 - DNA, 887 bp, Homo sapiens
gagcccctcccagcctgatacctgtataagggcaaagttcttcctttgtcctggtgtggttctgcagatctgggcttccgccaaaggctgtgtcaagagtgttaagggatggggtcgctgcccaaatgggtgttgttttcctgatgtggctgcctgttgtgtctcctccctagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggtgaggattctgtgctcttcgcaggggtgctgtttgcctgtggggtcggtgttccctccgcttggtattgaagacttgcggtcatccaacccacttacttctctctgcaaacataaaggctgtgatccagcaggctgggtctgtctgattccccaccacccactccagttgtttggtaggctgagcctttaaaaacaaaaccaaaaaactcattattgaaaagtccaaatattcatgaaagtgggaaaaacagtacaacaggccaccatgaattcgttgccttgcctctataattgtcaacgtttgttcaatttcactattcctaccccactccacacacatccattttttttttctggaatattttaaagcttatctcatacattattcatccataaatacttgagtatgtgtctctgactaaaaggacttaaaattttaaatataacctctgtgccgttatcactcataaaaaaatgaatacttaatgtc

SEQ ID NO: 459085 - DNA, 4366 bp, Homo sapiens
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgccacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatga

SEQ ID NO: 459086 - DNA, 4555 bp, Homo sapiens
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgccacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgcgtgccttggtcacgactgtgatgagcgggtgtgtcttgcatatgagaggttagggttccagtgtctcacagctcctccctgggctctcaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatga

SEQ ID NO: 459087 - DNA, 2915 bp, Homo sapiens
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagaggatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatga

SEQ ID NO: 459088 - DNA, 2949 bp, Homo sapiens
tactaggcccacagatagaagttaggagtcccctctatcaagtccttaggcccgacagctgcggggcctggtgttgggagagctggaggcttgaggattggaatgtggctcggtgccaccagcactctgggggagtttaccacctgcggggtgaagcctgctctcccgtgggattgattttccattgctcgcagtcatgtggcaggatggagcagactgacctttttccttttcaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctacaccccagattacatagtgtatcacgagttggtcatgaccaccaaggagtatatgcagtgtgtgaccgctgtggacggggagtggctggcggagctgggccccatgttctatagcgtgaaacaggcgggcaagtcacggcaggagaaccgtcgtcgggccaaagaggaagcctctgccatggaggaggagatggcgctggccgaggagcagctgcgagcccggcggcaggagcaggagaagcgcagccccctgggcagtgtcaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatga

SEQ ID NO: 459089 - DNA, 3799 bp, Homo sapiens
  misc_feature (3765)..(3765): n is a, c, g, or t
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgccacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtagtggctcggcgctcagacctgaagctcatcgtcacatcagccacgatggatgcggagaagtttgctgccttttttgggaatgtccccatcttccacatccctggccgtaccttccctgttgacatcctcttcagcaagaccccacaggaggattacgtggaggctgcagtgaagcagtccttgcaggtgcacctgtcgggggcccctggagacatccttatcttcatgcctggccaagaggacattgaggtgacctcagaccagattgtggagcatctggaggaactggagaacgcgcctgccctggctgtgctgcccatctactctcagctgccttctgacctccaggccaaaatcttccagaaggctccagatggcgttcggaagtgcatcgttgccaccaatattgccgagacgtctctcactgttgacggcatcatgtttgttatcgattctggttattgcaaattaaaggtcttcaaccccaggattggcatggatgctctgcagatctatcccattagccaggccaatgccaaccagcggtcagggcgagccggcaggacgggcccaggtcagtgtttcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaagggaatcggggagtacgtgaacatccgcacagggatgccctgccacttgcaccccaccagctccctttttggaatgggctgaaaaaaaaccccaaaaacctgttgatcccaatacactatcctatacacatataccattgctttaacanacattcaagccgacagggagcgagctcgatgtaa

SEQ ID NO: 459090 - DNA, 2300 bp, Homo sapiens
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacagacattatcggtctgctcgggtagagactccatcccatccgggtggtgtgagcgaagagttttgggaacgcagtcggcagagagagcgggagcggcgggaacatggtgtctatgcctcgtccaaagaagaaaaggattggaagaaggagaaatcgcgggatcgagactatgaccgcaagagggacagagatgagcgggatagaagtaggcacagcagcagatcagagcgagatggagggtcagagcgtagcagcagaagaaatgaacccgagagcccacgacatcgacctaaagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtctgtgaggggcaagtactcggatgacacgcctctgccaactccctcctacaaatataacgagtgggccgatgacagaagacacttggggtccaccccgcgtctgtccaggggccgaggaagacgtgaggagggcgaagaaggaatttcatttgacacggaggaggagcggcagcagtgggaagatgaccagaggcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcagccggagccggtgattccagtgaaggatgccacttctgacctggccatcattgctcggaaaggcagccagacagtgcggaagcacagggagcagaaggagcgcaagaaggctcagcacaaacactgggaactggcggggaccaaactgggagatataatgggcgtcaagaaggaggaagagccagataaagctgtgacggaggatgggaaggtggactacaggacagagcagaagtttgcagatcacatgaagagaaagagcgaagccagcagtgaatttgcaaagaagaagtccatcctggagcagaggcagtacctgcccatctttgcagtgcagcaggagctgctcactattatcagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgagtgggcgtgggggctgagccatgtagttattccctagtagcttccacccatttttgctaaagggtgtgatctgctaagactcggaccccagtacggggtgtgctggtggt

SEQ ID NO: 459091 - DNA, 667 bp, Homo sapiens
tcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacgtcaagttttaaaaaaaaaacaaaacaggcaaaaacaagtggtttttccaaaaactgcggttttaaaagctttgttttgatcattaaacattata

SEQ ID NO: 459092 - DNA, 2176 bp, Homo sapiens
ggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccagggcttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttccaaaaaaaaaaaaaacaagaaacaaaaaaaaacaaaaagaaaaaaacaaaaccagaaagaggggggcggcacacacccagagagacccacgactaccacatatagaagagtacagaagagaaaaacacaggcgccgaaaaaggagcagacgcaagtaagagacacgcaggaagaaccaaaacaggaaaaggaatgacagagggcgcaactacacacacagcgacacacccc

SEQ ID NO: 459093 - DNA, 2202 bp, Homo sapiens
ggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtatgtaagggtgctgtcaacctgtggggctagtgcacaagcgcccattgtacccccattccaaatccccacagtcccagcatcctagagcctgcattttcgggcggggaagccatggcagggtagccatggcggggtgaaatgagactggctttggggctaggcctcggagtcccaggaggcttgtcttccccacccaggcttatcccgtcctggggccccagtcctcggccctgtgagcctcacttcctctaggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccagggcttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 459094 - DNA, 1780 bp, Homo sapiens
acacgatgggcaaaggccttgggcaggagggagcgggatagaggaccggagagaaagcagtgtggctgcggtcctgaggttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccagggcttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 459095 - DNA, 1978 bp, Homo sapiens
ggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcgtcctcggccctgtgagcctcacttcctctaggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccagggcttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 459096 - DNA, 1471 bp, Homo sapiens
tgctgaccgtccctccttggcccacaggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccagggcttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 459097 - DNA, 1754 bp, Homo sapiens
tccatgtcagccggcctctccttgcgggcctgcttgggtgctttggtccttttgtgggaactatagtttcccatggcagggctggtcaccactggggacgatggcccacactccgtctgctctgccccctgggccctggcaacattgtgacctcacgggctgacctcaccaattgcaggctctgagcaccgccttccagggcccacaggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggtgagggccgtggggccagggccccacaagggaggaccctcctggtatccaccagagccaggcccatgctggaggcccggcccacactctgtgccctcacaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccagggcttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 459098 - DNA, 1540 bp, Homo sapiens
ctagccttggtttctcagctgtaaaactgggctaatgatcataaatgaggcaatgcatgtaaggtgcttagtggtgaatagagggggatttctgtggtttgggtatgaattttggccctgctactaacttgctatgtgaccttagcccaggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaagcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccagggcttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 459099 - DNA, 1011 bp, Homo sapiens
ggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccagggcttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 459100 - DNA, 1033 bp, Homo sapiens
ggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgggagatgcgctgtggctcaggagatgtgcgccgtggcagcgatgggaaagtggcccagagtcagggctcgggagatgcactgtggctcgggagatgagcgccatgacagagatgggaaggtggcccagagtcagggctcgggagatgcgcgccgtgacggagatgggaaagtggcctggagtcagggctcgggagatgtgcgctgtgccggaggtgggaaagtgccgtcgcaaatggagcttcgtctgcctctggg

SEQ ID NO: 459101 - DNA, 740 bp, Homo sapiens
ggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctgggtgagtggagtggctgatggtgggggatccactgtgaggcagtgggcatctgctgtgctgtgggatcctccacagtcttgactcagggttatagagctaggggcttgggttcaaatcctggctcccactttgtagctgtgccccttgacctctctgggcctgtttcctcatctgtaaaccatcataacaatagagctgcccttcatacatcactgtgaccagtgagaacgaaggca

SEQ ID NO: 459102 - DNA, 1947 bp, Homo sapiens
ggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccagggcttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 459103 - DNA, 2049 bp, Homo sapiens
ggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggtgagggccgtggggccagggccccacaagggaggaccctcctggtatccaccagagccaggcccatgctggaggcccggcccacactctgtgccctcacaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccagggcttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 459104 - DNA, 1912 bp, Homo sapiens
ggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccagggcttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 459105 - DNA, 1699 bp, Homo sapiens
  misc_feature (15)..(15): n is a, c, g, or t
tcttgaggtatccgnccccccgatgtatggatatcgtcgaccaggcgctcgcagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccagggcttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 459106 - DNA, 1893 bp, Homo sapiens
ggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaagcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccagggcttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 459107 - DNA, 1912 bp, Homo sapiens
ggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggtgagggccgtggggccagggccccacaagggaggaccctcctggtatccaccagagccaggcccatgctggaggcccggcccacactctgtgccctcacaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctccctctggagccttctggactggccagcccagcgcaaagaccagggcttgtctcctcctggacttgggcctggtggaagggctctcagcccagggatcagggactgggctgcttgctttctatttattattgatttatttatccctgtattttattgtttgtcacttcagcctccaagctactttggcttctgcctggctcaggagacctggattctggtccctgctgtccctgcctggctgagcgacccagggcaggtcccgtccctgtctgggtgggcctcaggccatctggccgcctagcgagggtcctgctttcttcctgctgtcttgggaccaggcttctgctcctcctcagccagcggcagaagcagggctgatgctcagggaccccccaaccctcaaaccttgcctccgaggctgggcctgagctgggtgccccgtcgccctcccaggccactaggctctgactcttccagcacccatggatgtgccagaggcctctgggttggtttgcatgtcatttgcatatcgtttgcatgccctcatcccacccattctcagggcagtatgggaagccccaaggtgacctggccaagtagcaataatttgggtccagggtcacctattgcccccagaggcctctgaaccccaggctgggaccccagcacagaggcaataaaggcagtggtcccttcca

SEQ ID NO: 459108 - DNA, 1304 bp, Homo sapiens
ggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaaggccccccggctggaacccctgcgtgaagaggacctggccaaggggcctgacttgcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccagacctgcacacgccgagggccccgggaccctgcctgcctctgaaccccaggctgggaccccagcacagaggcaataaaggcagtggtcccttcca

SEQ ID NO: 459109 - DNA, 1366 bp, Homo sapiens
  misc_feature (1351)..(1351): n is a, c, g, or t
ggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgacaatttagaaacagaaaaactgtgtgactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcggtcagatgcagagagcgtggaggcgcagagcaggctctgcggcagccggcgggcaggacgccgagccctgaggagtgtcagccggtcatccacctggtcccccggctcttctgacacagggcgcagctcagaggccgagatgcagtggcggctccaggtgaaccgcctccaggagctcatcgaccagctcgagtgcaagcacatcctcatggcccagaggcaggtccaggtggcagaggaaggcctgcaggacttccaccgagccctgcgctgctatgtggacttcacaggggcccagagccattgtctgcatgtgtccgcccagaagatgctggacggtgcctccttcaccctgtatgagttctggcaggatgaggcctcctggagaaggcaccagcagtcgcctggcagcaaggccttccagcgcatcctcatcgaccacctgcgggccccggacaccctcaccactgtgttcttcccagcctcctggtggataatgaataacaactgagccattgcactccggcctgggagacacagcgagactctgtctccaaaaaaaaaggtgctttttgaaaatgttgaggttgaaatgatgggaaccaacattcttcggatttagtaggggagcataatagcaaacacccccttggttcgcacatgtacaggaatgggactaagttggggcacagccattgcactccgcataantcctgctagagtcag

SEQ ID NO: 459110 - DNA, 778 bp, Homo sapiens
ggcctgagcccgcgcgtcggcgccggcgccaaggggcggcctctagccacaccgagtccgccgcggcgtccagggtcggcagcaaccgcagccgagcccgagcgggtggcggcgccatggcgtgcgcggggctgctcaccgtgtgcctgctccggccgcccgcgccccagccccagccccagaccccgcggcacccccagctcgcgcccgacccggggcccgccggacacacgctcttccaggacgttttccgcagagcagacaagaatgatgatgggaagctctcatttgaggaattccagaattactttgccgatggggttctcagcctgggggagctgcaggaactgttcagcggcattgatgggcatctcaccgagtgagtatgagagggggccgtggactacttctcagagcacctgggtgtctaccggccggtgctggctgcattggaatcgctgaaccgtgcagtgctcgctgccatggatgccaccaagctggagtacgagagggcctccaaagtggaccagtttgtgacgcgcttcctgctgcgggagacggtgagccagctgcaagcccttcagagctcgctggagggggcgtcagataccctggaggcccaggcccatggctggcgcagaatcagagagcgtgtgggcgcatatcagctcttcggaacccgtcagatgaagccgaacccttagcattcaaccggcaccacctgtccccgggtctctgacacggggcggtcacggcgactcgtggcgtccggtccgtc

SEQ ID NO: 459111 - DNA, 1442 bp, Homo sapiens
cgcctagtaggcaggcgctctcagctctctccccggtacgtgacgagactccacggacgtcacgtgaggcaggcggcgagcgcgggtggggcggggttaggcggcgctccgcgagaaccaaagtgcagccgctgacccggcaaaactcagcgggggctggatagccatgcccaagtactgcagggcgccgaactgctccaacactgcgggccgcctgggtgcagacaaccgccctgtgagcttctacaagttcccactgaaggatggtccccggctgcaggcctggctgcagcacatgggctgtgagcactgggtgcccagctgccaccagcacttgtgcagcgagcacttcacaccctcctgcttccagtggcgctggggtgtgcgctacctgcggcctgatgcagtgccctccatcttctcccggggaccacctgccaagagtcagcggaggacccgaagcacccagaagccagtctcgccgccgcctcccctacagaagaatacacccctgccccagagccctgccatcccagtctctggcccagtgcgcctagtggtgctgggccccacatcggggagccccaagactgtggccaccatgctcctgacccccctggcccctgcgccaactcctgagcggtcacaacctgaagtccctgcccaacaggcccagaccgggctgggcccagtgctgggagcactgcaacgccgggtgcggaggctgcaacggtgccaggagcggcaccaggcgcagctgcaggccctggaacggctggcacagcagctacacggggagagcctgctggcacgggcacgccggggtctgcagcgcctgacaacagcccagacccttggacctgaggaatcccaaaccttcaccatcatctgtggagggcctgacatagccatggtccttgcccaggaccctgcacctgccacagtggatgccaagccggagctcctggacactcggatccccagtgcataaggatcaagacagacaatgtcgagggacaaaagatagaagatggaggaggaaagacattatacgtgggcttggcccagccccaccgcccacgcctgggtagtagcagtgcctccctcaagggcctgggttctaccaccccactcctagggatctcttgaaccttaggggtgacctgggcccaagtctctcatcagcccccaatcccctgggtaccaggcttctgccacccccggctcagatctttgcaaatcagtacgacagcctcagagcagagcaagggttgtttgggagaatcatacctggttctaaggagtcccacgctttttgccaagcctggtactgagttcatgataccatggtggacacagctgagaaaatccctgccctcatggtgctcattctacttgagtagacgatgaactagtaaacaaataaacaagaacactgcaga

SEQ ID NO: 459112 - DNA, 1249 bp, Homo sapiens
cgcctagtaggcaggcgctctcagctctctccccggtacgtgacgagactccacggacgtcacgtgaggcaggcggcgagcgcgggtggggcggggttaggcggcgctccgcgagaaccaaagtgcagccgctgacccggcaaaactcagcgggggctggatagccatgcccaagtactgcagggcgccgaactgctccaacactgcgggccgcctgggtgcagacaaccgccctgtgagcttctacaaagtcagcggaggacccgaagcacccagaagccagtctcgccgccgcctcccctacagaagaatacacccctgccccagagccctgccatcccagtctctggcccagtgcgcctagtggtgctgggccccacatcggggagccccaagactgtggccaccatgctcctgacccccctggcccctgcgccaactcctgagcggtcacaacctgaagtccctgcccaacaggcccagaccgggctgggcccagtgctgggagcactgcaacgccgggtgcggaggctgcaacggtgccaggagcggcaccaggcgcagctgcaggccctggaacggctggcacagcagctacacggggagagcctgctggcacgggcacgccggggtctgcagcgcctgacaacagcccagacccttggacctgaggaatcccaaaccttcaccatcatctgtggagggcctgacatagccatggtccttgcccaggaccctgcacctgccacagtggatgccaagccggagctcctggacactcggatccccagtgcataaggatcaagacagacaatgtcgagggacaaaagatagaagatggaggaggaaagacattatacgtgggcttggcccagccccaccgcccacgcctgggtagtagcagtgcctccctcaagggcctgggttctaccaccccactcctagggatctcttgaaccttaggggtgacctgggcccaagtctctcatcagcccccaatcccctgggtaccaggcttctgccacccccggctcagatctttgcaaatcagtacgacagcctcagagcagagcaagggttgtttgggagaatcatacctggttctaaggagtcccacgctttttgccaagcctggtactgagttcatgataccatggtggacacagctgagaaaatccctgccctcatggtgctcattctacttgagtagacgatgaactagtaaacaaataaacaagaacactgcaga

SEQ ID NO: 459113 - DNA, 1416 bp, Homo sapiens
cgcctagtaggcaggcgctctcagctctctccccggtacgtgacgagactccacggacgtcacgtgaggcaggcggcgagcgcgggtggggcggggttaggcggcgctccgcgagaaccaaagtgcagccgctgacccggcaaaactcagcgggggctggatagccatgcccaagtactgcagggcgccgaactgctccaacactgcgggccgcctgggtgcagacaaccgccctgtgagcttctacaagttcccactgaaggatggtccccggctgcaggcctggctgcagcacatgggctgtgagcactgggtgcccagctgccaccagcacttgtgcagcgagcacttcacaccctcctgcttccagtggcgctggggtgtgcgctacctgcggcctgatgcagtgccctccatcttctcccggggaccacctgccaagagtcagcggaggacccgaagcacccagaagccagtctcgccgccgcctcccctacagaagaatacacccctgccccagagccctgccatcccagtctctggcccagtgcgcctagtggtgctgggccccacatcggggagccccaagactgtggccaccatgctcctgacccccctggcccctgcgccaactcctgagcggtcacaacctgaagtccggcccagtgctgggagcactgcaacgccgggtgcggaggctgcaacggtgccaggagcggcaccaggcgcagctgcaggccctggaacggctggcacagcagctacacggggagagcctgctggcacgggcacgccggggtctgcagcgcctgacaacagcccagacccttggacctgaggaatcccaaaccttcaccatcatctgtggagggcctgacatagccatggtccttgcccaggaccctgcacctgccacagtggatgccaagccggagctcctggacactcggatccccagtgcataaggatcaagacagacaatgtcgagggacaaaagatagaagatggaggaggaaagacattatacgtgggcttggcccagccccaccgcccacgcctgggtagtagcagtgcctccctcaagggcctgggttctaccaccccactcctagggatctcttgaaccttaggggtgacctgggcccaagtctctcatcagcccccaatcccctgggtaccaggcttctgccacccccggctcagatctttgcaaatcagtacgacagcctcagagcagagcaagggttgtttgggagaatcatacctggttctaaggagtcccacgctttttgccaagcctggtactgagttcatgataccatggtggacacagctgagaaaatccctgccctcatggtgctcattctacttgagtagacgatgaactagtaaacaaataaacaagaacactgcaga

SEQ ID NO: 459114 - DNA, 2065 bp, Homo sapiens
cgcctagtaggcaggcgctctcagctctctccccggtacgtgacgagactccacggacgtcacgtgaggcaggcggcgagcgcgggtggggcggggttaggcggcgctccgcgagaaccaaagtgcagccgctgacccggcaaaactcagcgggggctggatagccatgcccaagtactgcagggcgccgaactgctccaacactgcgggccgcctgggtgcagacaaccgccctgtgagcttctacaagttcccactgaaggatggtccccggctgcaggcctggctgcagcacatgggctgtgagcactgggtgcccagctgccaccagcacttgtgcagcgagcacttcacaccctcctgcttccagtggcgctggggtgtgcgctacctgcggcctgatgcagtgccctccatcttctcccggggaccacctgccaagagtcagcggaggacccgaagcacccagaagccagtctcgccgccgcctcccctacagaagaatacacccctgccccagagccctgccatcccagtctctggcccagtgcgcctagtggtgctgggccccacatcggggagccccaagactgtggccaccatgctcctgacccccctggcccctgcgccaactcctgagcggtcacaacctgaagtccctgcccaacaggcccagaccgggctgggcccagtgctgggagcactgcaacgccgggtgcggaggctgcaacggtgccaggagcggcaccaggcgcagctgcaggccctggaacggctggcacagcagctacacggggagagcctgctggcacgggcacgccggggtctgcagcgcctgacaacagcccagacccttggacctgaggaatcccaaaccttcaccatcatctgtggagggcctgacatagccatggtccttgcccaggaccctgcacctgccacagtggatgccaagccggagctcctggacactcggatccccagtgcataaggatcaagacagacaatgtcgagggacaaaagatagaagatggaggaggaaagacattatacgtgggcttggcccagccccaccgcccacgcctgggtagtagcagtgcctccctcaagggcctgggttctaccaccccactcctagggatctcttgaaccttaggggtgacctgggcccaagtctctcatcagcccccaatcccctgggtaccaggcttctgccacccccggctcagatctttgcaaatcagtacgacagcctcagagcagagcaagggttgtttgggagaatcatacctggttctaaggagtcccacgctttttgccaagcctggtactgagttcatgataccatggtggacacagctgagaaaatccctgccctcatggtgctcattctacttgagtagacgatgaactagtaaacaaataaacaagaacactgcagacatgagcgatgagtgctataaagacaacaaaaatttggtttgggcctgggggagggccctccaaggccatgttttagcagaaacctgggtgatcagaaggggctggcctggagcgctacaggctcaggttccagaggacgaacaacccctgcagtgagggcctgctgtctgggatgtgtcaggtctgggaggcggtgttgctatggagaaaaccatagtagggaagggaggaaggggtgcagttttagagcagagaaggtgaaaagacaccaacaagtaagatcctaaaacagggcagagagggagccacgtagggatttggaggaagagcattccgggcatcacaaagagccgttgcaggccaggcacggtggctcacgcctgtcgtcccagcactttgggaagctgaggcaggcagataacctaaggtcaggagtttgagaccagcctggccaacatggcgaaaccccgtccctactaaaaatacaaaaattagctgggtgtggtggcacaggcctgtaatcccagctactcgggaggctgaggcaggagaatcacttgaacctggaagacagaggttgcagtgagcagagatcatgccactccactccagcctggggaac

SEQ ID NO: 459115 - DNA, 757 bp, Homo sapiens
gttatactgctgctgctgcataggtacatggtataagaatcatgttttttttatctttgagaaaatgagttaaaggcttgcttcttcacttaactgcaacacagtttacagattcagatttcacattttgctaagtataaatgacatatcttaagactaatgaaaactttcatgttttacttgtatttattatggtaacttttcttttcatagccatgttcactgcccacttcccatgagatttctccagtgcccgccagacctgactggaaaaagtcattatcttgatgaagcagatgtattttacctaaatcccttaaactggttacatagagagtttcatgatgatgcatcattgcctactcacttgatcaccttcagcattttggaagaggaaataagcgctttcctaatttcaagcaattataaaagaactgctgttttcttccacactcacttgccagagggtcgaattggaagtcacatatatgtctatgaacggaagttaaaagggaaattcaacatgaagatgaaattctgaactttcctagataaattaacattgctgggtggaaatattcagatgctgcttaaatacttcggtaaacactgggtaagattcatggaacttagaaaaaagctgtatgaactgctttaccaaatatcactactgaggaaatgtataaaataccacatagtataaaattacatgttaatacaatgccagattttaaataaagacctttagttttcctca

SEQ ID NO: 459116 - DNA, 1004 bp, Homo sapiens
cttggcactaacacatttctatttatttttccttcaacggtgccagtggactctggttcaatttaattttttgaaatttaacgtgctgcagaactggggaacattttatggttctcatccatggcactggtacttcagtcaaggatttccagttatcttgggtactcacttacccttctttattcatggctgctatctagcaccaaagagataccggatacttttggtgactgtgctgtggacactgcttgtttataggtaagattttatttgttcaaaaggctaaaattttttatgttaccaagaaatcaaattaaattcttcaaaaagtaaactttatgttttggaggtgccattaacttttgttagtgggaattatcttagaagatacaagtagtagtaattatggaggcactagagtgaatactttagatatgtagtttgcttaataaggattacactcaatttttaagaacttggactaattttatttgctttaaaaaaaaaaaaaacagaccaggcacagttgctcatgcctgtaatttcaatactttgaaggccaaggtgggaggattgcttgaagcaaggagttcatgaccagcctgagcaacatagcaagaccctctctctgaaaaaaaatttaaaattaccagggcatgatggcatgtgcctgtagtcctagctattggggaagctgaggcagaaggactgcttgagcccaggaatttaaggttgcagtgagctatgattgtgctactgcactccagtctgggtgacaaaacaagaccctgtctcagtcaatcagtcaatcaatactaccaaaattttaaattgaaggaccacagaaatacattctaaaataaaaatgtatgtatccttattccaaatttgactaatttcacttacttggattgaaatagaaatcccgtttttagaatgtaactgtactttgtaatttcaaattgacatcatattttatgattagttttaccatatcataatca

SEQ ID NO: 459117 - DNA, 2937 bp, Homo sapiens
cttttcgtcaaccccttgtggtgttgtcccttatgggtccatatgctgcctatttgctttccgtcgcttttggtgtcgctccttcggggggcctagggtcccgactgttttagattttggcaaaccttaggtttcagcaaatgacttcgtttaccctggaggtccaatttcccagggctgccactttactgccaaccgtagggtaggagcttccaagtgttcacatcgtcacaccactggaatttccatcgtgtgacgcagtcatcctgtatcccagctgctcgggagtctgggattacaggcgcatgccaccaagcctggctgatttttgtatttttagtagagacagggtttcaccatgttggtcaggctggtcttgaactcctgaccacctgatccacccgcctcggcctcccaaagtgctgggattacaggcgtgagccactgcgccaggcctaactccatgtagtattaacttttcttctcttctgattcttgtaccaactgcatcttttcttgttaattccttctgatctttggcatactgttcaaatactggttgaaaaatatatactcctccagcaattccaaggacagtggcaaaaagcagttgtgcaaaagtcaatctcctaaacattgctgcaacaaatacagctcaaggaaaagctggttttggaaagtcacactccacacccaggaaatctcttcaaatcgtttttaataaccactcaggtacctccgactgttctgcgcctgctccacgtcactaaactcgctaccgcctgctcccctccagagaccgggggccttccagcagttttcggacccccgagcacagagaccgccaagccaaaggcgagtagcaatccctcggttcggaaacggcgaaaggaaaccgcaaggaggccaccacgtcgggtgggagctacgaagttgcccgttcccggttacttccgggcttgcgagcgacgactgctctcaaaggccaaacttaatggatggacgagcagcgcgctactgcagctttcttccgccttaggaaggtggcggccagggatgaggaggcccctaagcaagtgcggaatggagccggggggcggagatgccagcctcactttgcatggtctccagaaccgctcccacggcaagataaagctgcgaaagagaaagtctaccttgtacttcaacacccaggagaagagcgccaggcgccgcggggatcttcttggagaaaatatttatctgctcttgtttaccatagctttacgaatattaaactgctttttagtgcagacaagttttgttccagatgaatactggcagtctcttgaagtttcacatcacatggttttcaattatggttatttgacttgggaatggacagagagactgaggagttacacttatcccttaatctttgcaagcatttacaagattcttcatcttttagggaaagatagtgttcagttgctgatttggattcctagacttgcccaagcacttctgtctgctgtagcagatgtgagactttactcattaatgaagcaactagaaaatcaggaagtggcaagatgggtgtttttttgccagttgtgctcctggttcacatggtattgctgtaccagaacccttacaaacaccatggaaactgttctcactataattgctcttttctactatcctttggaaggttcaaagtctatgaacagtgtcaaatactcatccctggtggcacttgccttcataattcgtcccacagctgtcattctgtggacacctttgctcttcagacatttctgtcaagaaccaagaaagcttgatcttattctacatcattttttacctgtaggctttgttactttgagtttgtctctgatgattgatcgtattttttttggccaatggactctggttcaatttaattttttgaaatttaacgtgctgcagaactggggaacattttatggttctcatccatggcactggtacttcagtcaaggatttccagttatcttgggtactcacttacccttctttattcatggctgctatctagcaccaaagagataccggatacttttggtgactgtgctgtggacactgcttgtttatagcatgttgagccacaaagaattcaggtttatttatccagttttaccattctgtatggtgttctgtggatactcattaacccacctgaaaacatggaagaaaccagctctaagtttcctgtttttatcaaatttgttcctcgccctttatactggtttagttcatcaacgaggtactcttgatgtcatgagtcatattcaaaaagtttgttacaacaatcccaataaatcttcagcttcaatatttataatgatgccttgccactctactccttattacagccatgttcactgcccacttcccatgagatttctccagtgcccgccagacctgactggaaaaagtcattatcttgatgaagcagatgtattttacctaaatcccttaaactggttacatagagagtttcatgatgatgcatcattgcctactcacttgatcaccttcagcattttggaagaggaaataagcgctttcctaatttcaagcaattataaaagaactgctgttttcttccacactcacttgccagagggtcgaattggaagtcacatatatgtctatgaacggaagttaaaagggaaattcaacatgaagatgaaattctgaactttcctagataaattaacattgctgggtggaaatattcagatgctgcttaaatacttcggtaaacactgggtaagattcatggaacttagaaaaaagctgtatgaactgctttaccaaatatcactactgaggaaatgtataaaataccacatagtataaaattacatgttaatacaatgccagattttaaataaagacctttagttttcctca

SEQ ID NO: 459118 - DNA, 2683 bp, Homo sapiens
cttttcgtcaaccccttgtggtgttgtcccttatgggtccatatgctgcctatttgctttccgtcgcttttggtgtcgctccttcggggggcctagggtcccgactgttttagattttggcaaaccttaggtttcagcaaatgacttcgtttaccctggaggtccaatttcccagggctgccactttactgccaaccgtagggtaggagcttccaagtgttcacatcgtcacaccactggaatttccatcgtgtgacgcagtcatcctgtatcccagctgctcgggagtctgggattacaggcgcatgccaccaagcctggctgatttttgtatttttagtagagacagggtttcaccatgttggtcaggctggtcttgaactcctgaccacctgatccacccgcctcggcctcccaaagtgctgggattacaggcgtgagccactgcgccaggcctaactccatgtagtattaacttttcttctcttctgattcttgtaccaactgcatcttttcttgttaattccttctgatctttggcatactgttcaaatactggttgaaaaatatatactcctccagcaattccaaggacagtggcaaaaagcagttgtgcaaaagtcaatctcctaaacattgctgcaacaaatacagctcaaggaaaagctggttttggaaagtcacactccacacccaggaaatctcttcaaatcgtttttaataaccactcaggtacctccgactgttctgcgcctgctccacgtcactaaactcgctaccgcctgctcccctccagagaccgggggccttccagcagttttcggacccccgagcacagagaccgccaagccaaaggcgagtagcaatccctcggttcggaaacggcgaaaggaaaccgcaaggaggccaccacgtcgggtgggagctacgaagttgcccgttcccggttacttccgggcttgcgagcgacgactgctctcaaaggccaaacttaatggatggacgagcagcgcgctactgcagctttcttccgccttaggaaggtggcggccagggatgaggaggcccctaagcaagtgcggaatggagccggggggcggagatgccagcctcactttgcatggtctccagaaccgctcccacggcaagataaagctgcgaaagagaaagtctaccttgtacttcaacacccaggagaagagcgccaggcgccgcggggatttggattcctagacttgcccaagcacttctgtctgctgtagcagatgtgagactttactcattaatgaagcaactagaaaatcaggaagtggcaagatgggtgtttttttgccagttgtgctcctggttcacatggtattgctgtaccagaacccttacaaacaccatggaaactgttctcactataattgctcttttctactatcctttggaaggttcaaagtctatgaacagtgtcaaatactcatccctggtggcacttgccttcataattcgtcccacagctgtcattctgtggacacctttgctcttcagacatttctgtcaagaaccaagaaagcttgatcttattctacatcattttttacctgtaggctttgttactttgagtttgtctctgatgattgatcgtattttttttggccaatggactctggttcaatttaattttttgaaatttaacgtgctgcagaactggggaacattttatggttctcatccatggcactggtacttcagtcaaggatttccagttatcttgggtactcacttacccttctttattcatggctgctatctagcaccaaagagataccggatacttttggtgactgtgctgtggacactgcttgtttatagcatgttgagccacaaagaattcaggtttatttatccagttttaccattctgtatggtgttctgtggatactcattaacccacctgaaaacatggaagaaaccagctctaagtttcctgtttttatcaaatttgttcctcgccctttatactggtttagttcatcaacgaggtactcttgatgtcatgagtcatattcaaaaagtttgttacaacaatcccaataaatcttcagcttcaatatttataatgatgccttgccactctactccttattacagccatgttcactgcccacttcccatgagatttctccagtgcccgccagacctgactggaaaaagtcattatcttgatgaagcagatgtattttacctaaatcccttaaactggttacatagagagtttcatgatgatgcatcattgcctactcacttgatcaccttcagcattttggaagaggaaataagcgctttcctaatttcaagcaattataaaagaactgctgttttcttccacactcacttgccagagggtcgaattggaagtcacatatatgtctatgaacggaagttaaaagggaaattcaacatgaagatgaaattctgaactttcctagataaattaacattgctgggtggaaatattcagatgctgcttaaatacttcggtaaacactgggtaagattcatggaacttagaaaaaagctgtatgaactgctttaccaaatatcactactgaggaaatgtataaaataccacatagtataaaattacatgttaatacaatgccagattttaaataaagacctttagttttcctca

SEQ ID NO: 459119 - DNA, 913 bp, Homo sapiens
gtgaatggtcagagatatgacttattgcttatttcttatttgtctataacagtattacagtttttgctatttccattaaaaattacagatgtatttgcagttaacataacaaaagattgtcagtgttaaggttcaatatgtctatcttcatataggatactcattaacccacctgaaaacatggaagaaaccagctctaagtttcctgtttttatcaaatttgttcctcgccctttatactggtttagttcatcaacgaggtactcttgatgtcatgagtcatattcaaaaagtttgttacaacaatcccaataaatcttcagcttcaatatttataatgatgccttgccactctactccttattacagccatgttcactgcccacttcccatgagatttctccagtgcccgccagacctgactggaaaaagtcattatcttgatgaagcagatgtattttacctaaatcccttaaactggttacatagagagtttcatgatgatgcatcattgcctactcacttgatcaccttcagcattttggaagaggaaataagcgctttcctaatttcaagcaattataaaagaactgctgttttcttccacactcacttgccagagggtcgaattggaagtcacatatatgtctatgaacggaagttaaaagggaaattcaacatgaagatgaaattctgaactttcctagataaattaacattgctgggtggaaatattcagatgctgcttaaatacttcggtaaacactgggtaagattcatggaacttagaaaaaagctgtatgaactgctttaccaaatatcactactgaggaaatgtataaaataccacatagtataaaattacatgttaatacaatgccagattttaaataaagacctttagttttcctca

SEQ ID NO: 459120 - DNA, 2860 bp, Homo sapiens
cttttcgtcaaccccttgtggtgttgtcccttatgggtccatatgctgcctatttgctttccgtcgcttttggtgtcgctccttcggggggcctagggtcccgactgttttagattttggcaaaccttaggtttcagcaaatgacttcgtttaccctggaggtccaatttcccagggctgccactttactgccaaccgtagggtaggagcttccaagtgttcacatcgtcacaccactggaatttccatcgtgtgacgcagtcatcctgtatcccagctgctcgggagtctgggattacaggcgcatgccaccaagcctggctgatttttgtatttttagtagagacagggtttcaccatgttggtcaggctggtcttgaactcctgaccacctgatccacccgcctcggcctcccaaagtgctgggattacaggcgtgagccactgcgccaggcctaactccatgtagtattaacttttcttctcttctgattcttgtaccaactgcatcttttcttgttaattccttctgatctttggcatactgttcaaatactggttgaaaaatatatactcctccagcaattccaaggacagtggcaaaaagcagttgtgcaaaagtcaatctcctaaacattgctgcaacaaatacagctcaaggaaaagctggttttggaaagtcacactccacacccaggaaatctcttcaaatcgtttttaataaccactcaggtacctccgactgttctgcgcctgctccacgtcactaaactcgctaccgcctgctcccctccagagaccgggggccttccagcagttttcggacccccgagcacagagaccgccaagccaaaggcgagtagcaatccctcggttcggaaacggcgaaaggaaaccgcaaggaggccaccacgtcgggtgggagctacgaagttgcccgttcccggttacttccgggcttgcgagcgacgactgctctcaaaggccaaacttaatggatggacgagcagcgcgctactgcagctttcttccgccttaggaaggtggcggccagggatgaggaggcccctaagcaagtgcggaatggagccggggggcggagatgccagcctcactttgcatggtctccagaaccgctcccacggcaagataaagctgcgaaagagaaagtctaccttgtacttcaacacccaggagaagagcgccaggcgccgcggggatcttcttggagaaaatatttatctgctcttgtttaccatagctttacgaatattaaactgctttttagtgcagacaagttttgttccagatgaatactggcagtctcttgaagtttcacatcacatggttttcaattatggttatttgacttgggaatggacagagagactgaggagttacacttatcccttaatctttgcaagcatttacaagattcttcatcttttagggaaagatagtgttcagttgctgatttggattcctagacttgcccaagcacttctgtctgctgtagcagatgtgagactttactcattaatgaagcaactagaaaatcaggaagtggcaagatgggtgtttttttgccagttgtgctcctggttcacatggtattgctgtaccagaacccttacaaacaccatggaaactgttctcactataattgctcttttctactatcctttggaaggttcaaagtctatgaacagtgtcaaatactcatccctggtggcacttgccttcataattcgtcccacagctgtcattctgtggacacctttgctcttcagacatttctgtcaagaaccaagaaagcttgatcttattctacatcattttttacctgtaggctttgttactttgagtttgtctctgatgattgatcgtattttttttggccaatggactctggttcaatttaattttttgaaatttaacgtgctgcagaactggggaacattttatggttctcatccatggcactggtacttcagtcaaggatttccagttatcttgggtactcacttacccttctttattcatggctgctatctagcaccaaagagataccggatacttttggtgactgtgctgtggacactgcttgtttataggtaagattttatttgttcaaaaggctaaaattttttatgttaccaagaaatcaaattaaattcttcaaaaagtaaactttatgttttggaggtgccattaacttttgttagtgggaattatcttagaagatacaagtagtagtaattatggaggcactagagtgaatactttagatatgtagtttgcttaataaggattacactcaatttttaagaacttggactaattttatttgctttaaaaaaaaaaaaaacagaccaggcacagttgctcatgcctgtaatttcaatactttgaaggccaaggtgggaggattgcttgaagcaaggagttcatgaccagcctgagcaacatagcaagaccctctctctgaaaaaaaatttaaaattaccagggcatgatggcatgtgcctgtagtcctagctattggggaagctgaggcagaaggactgcttgagcccaggaatttaaggttgcagtgagctatgattgtgctactgcactccagtctgggtgacaaaacaagaccctgtctcagtcaatcagtcaatcaatactaccaaaattttaaattgaaggaccacagaaatacattctaaaataaaaatgtatgtatccttattccaaatttgactaatttcacttacttggattgaaatagaaatcccgtttttagaatgtaactgtactttgtaatttcaaattgacatcatattttatgattagttttaccatatcataatca

SEQ ID NO: 459121 - DNA, 1064 bp, Homo sapiens
gttatactgctgctgctgcataggtacatggtataagaatcatgttttttttatctttgagaaaatgagttaaaggcttgcttcttcacttaactgcaacacagtttacagattcagatttcacattttgctaagtataaatgacatatcttaagactaatgaaaactttcatgttttacttgtatttattatggtaacttttcttttcatagccatgttcactgcccacttcccatgagatttctccagtgcccgccagacctgactggaaaaagtcattatcttgatgaagcagatgtattttacctaaatcccttaaactggttacatagagagtttcatgatgatgcatcattgcctactcacttgatcaccttcagcattttggaagaggtaagtaaacatgaaaaagaggaaaactcagtattttaattttaccccaggtttaggaaaccctcaggtaaatagataatataacctttttatggtctgtttcaacccacatttcataattagtcttttctccagtcaaaattagccccagttctgtaactatcaaagtattttacttcctataagttaattcttttattaagcaaaaagttgtagacagcaattagaataggcaattctaaaattgactgaaacagtactcagcaaaatgtagcctttatttacttaaacatttatttgcttctaggaaataagcgctttcctaatttcaagcaattataaaagaactgctgttttcttccacactcacttgccagagggtcgaattggaagtcacatatatgtctatgaacggaagttaaaagggaaattcaacatgaagatgaaattctgaactttcctagataaattaacattgctgggtggaaatattcagatgctgcttaaatacttcggtaaacactgggtaagattcatggaacttagaaaaaagctgtatgaactgctttaccaaatatcactactgaggaaatgtataaaataccacatagtataaaattacatgttaatacaatgccagattttaaataaagacctttagttttcctca

SEQ ID NO: 459122 - DNA, 1740 bp, Homo sapiens
  misc_feature (1672)..(1672): n is a, c, g, or t
  misc_feature (1677)..(1677): n is a, c, g, or t
  misc_feature (1727)..(1727): n is a, c, g, or t
cttttcgtcaaccccttgtggtgttgtcccttatgggtccatatgctgcctatttgctttccgtcgcttttggtgtcgctccttcggggggcctagggtcccgactgttttagattttggcaaaccttaggtttcagcaaatgacttcgtttaccctggaggtccaatttcccagggctgccactttactgccaaccgtagggtaggagcttccaagtgttcacatcgtcacaccactggaatttccatcgtgtgacgcagtcatcctgtatcccagctgctcgggagtctgggattacaggcgcatgccaccaagcctggctgatttttgtatttttagtagagacagggtttcaccatgttggtcaggctggtcttgaactcctgaccacctgatccacccgcctcggcctcccaaagtgctgggattacaggcgtgagccactgcgccaggcctaactccatgtagtattaacttttcttctcttctgattcttgtaccaactgcatcttttcttgttaattccttctgatctttggcatactgttcaaatactggttgaaaaatatatactcctccagcaattccaaggacagtggcaaaaagcagttgtgcaaaagtcaatctcctaaacattgctgcaacaaatacagctcaaggaaaagctggttttggaaagtcacactccacacccaggaaatctcttcaaatcgtttttaataaccactcaggtacctccgactgttctgcgcctgctccacgtcactaaactcgctaccgcctgctcccctccagagaccgggggccttccagcagttttcggacccccgagcacagagaccgccaagccaaaggcgagtagcaatccctcggttcggaaacggcgaaaggaaaccgcaaggaggccaccacgtcgggtgggagctacgaagttgcccgttcccggttacttccgggcttgcgagcgacgactgctctcaaaggccaaacttaatggatggacgagcagcgcgctactgcagctttcttccgccttaggaaggtggcggccagggatgaggaggcccctaagcaagtgcggaatggagccggggggcggagatgccagcctcactttgcatggtctccagaaccgctcccacggcaagataaagctgcgaaagagaaagtctaccttgtacttcaacacccaggagaagagcgccaggcgccgcggggatcttcttggagaaaatatttatctgctcttgtttaccatagctttacgaatattaaactgctttttagtgcagacaagttttgttccagatgaatactggcagtctcttgaagtttcacatcacatggttttcaattatggttatttgacttgggaatggacagagagactgaggagttacacttatcccttaatctttgcaagcatttacaagattcttcatcttttagggaaagatagtgttcagttgctgatttggattcctagacttgcccaagcacttctgtctgctgtagcagatgtgagactttactcattaatgaagcaactagaaaatcaggaagtggcaagatgggtgtttttttgccagttgtgctcctggttcacatggtattgctgtaccagaacccttacaaacaccaatgggaaaactggttcctcaactaataaanttgcncctttttcccaactaaacccctttggggaaagggtttcaaaaaggtcccnaatggaaaccaag

SEQ ID NO: 459123 - DNA, 732 bp, Homo sapiens
tagatacacacatagtatgacctaattaattagcctaaggccttagttaacccactcttttttttttgtatttattttaatattatctttacacaataagttgcaagaaaagttggttaaactaaaagagtggcagtcacccagtgatgacgctgtggtgcttgtataaccaaccaagttggctttaagaatggtgtggagggaccagaggtcactactgtgccttacaaggagccaaccagagcagcagattttaagttttgcaagtggaactgcctgacttttgtgccactattacctgttttgttctgtttttcagatcttcttggagaaaatatttatctgctcttgtttaccatagctttacgaatattaaactgctttttagtgcagacaagttttgttccagatgaatactggcagtctcttgaagtttcacatcacatggttttcaaatatcctttgtggtttcttttccagactatgagtgtgtattcatcttggaaattgtgctcagtttcttttagagtagtcccccttgctccctcgtcttcagtagatagtttccaaaatccctagtggatgcttgaaactgtagacagtaccaaactctatatatattgtttttatatatgtaaaaaatacacacacgcttatgataaagtttatacaaattaggtacagtaagagattaacagtattaaaatataacaagtataacacaatactata

SEQ ID NO: 459124 - DNA, 571 bp, Homo sapiens
gcgtggtggcgcgcctgtagtcccagctacttgggagctgaggcaggaaaatcactggaacccgggaggcagaagttgcagtgagcccagattgcgccactgcactccagcctggactacaagagcgaaactccgtctcaaaaaaaaaaacaaaaacaaaaacaaaaaaaaaacctaacaacagcaacaacaacaaaaaaaataggaaccattcggcctgtttccacatctgtacaacaagctaaatcatccctaccctgcctacctcgttgaacaggcattttttgtgagagcaacgaacctgaaatgttaacaccaacactgacgtctacaattaccgttaccgtttttaataaccactcaggtacctccgactgttctgcgcctgctccacgtcactaaactcgctaccgcctgctcccctccagagaccgggggccttccagcagttttcggacccccgagcacagagaccgccaagccaaaggcgagtagcaatccctcggttcggaaacggcgaaaggaaaccgcaaggaggccaccacgtcgggtgggagctacgaagttgccc

SEQ ID NO: 459125 - DNA, 3244 bp, Homo sapiens
cttttcgtcaaccccttgtggtgttgtcccttatgggtccatatgctgcctatttgctttccgtcgcttttggtgtcgctccttcggggggcctagggtcccgactgttttagattttggcaaaccttaggtttcagcaaatgacttcgtttaccctggaggtccaatttcccagggctgccactttactgccaaccgtagggtaggagcttccaagtgttcacatcgtcacaccactggaatttccatcgtgtgacgcagtcatcctgtatcccagctgctcgggagtctgggattacaggcgcatgccaccaagcctggctgatttttgtatttttagtagagacagggtttcaccatgttggtcaggctggtcttgaactcctgaccacctgatccacccgcctcggcctcccaaagtgctgggattacaggcgtgagccactgcgccaggcctaactccatgtagtattaacttttcttctcttctgattcttgtaccaactgcatcttttcttgttaattccttctgatctttggcatactgttcaaatactggttgaaaaatatatactcctccagcaattccaaggacagtggcaaaaagcagttgtgcaaaagtcaatctcctaaacattgctgcaacaaatacagctcaaggaaaagctggttttggaaagtcacactccacacccaggaaatctcttcaaatcgtttttaataaccactcaggtacctccgactgttctgcgcctgctccacgtcactaaactcgctaccgcctgctcccctccagagaccgggggccttccagcagttttcggacccccgagcacagagaccgccaagccaaaggcgagtagcaatccctcggttcggaaacggcgaaaggaaaccgcaaggaggccaccacgtcgggtgggagctacgaagttgcccgttcccggttacttccgggcttgcgagcgacgactgctctcaaaggccaaacttaatggatggacgagcagcgcgctactgcagctttcttccgccttaggaaggtggcggccagggatgaggaggcccctaagcaagtgcggaatggagccggggggcggagatgccagcctcactttgcatggtctccagaaccgctcccacggcaagataaagctgcgaaagagaaagtctaccttgtacttcaacacccaggagaagagcgccaggcgccgcggggatcttcttggagaaaatatttatctgctcttgtttaccatagctttacgaatattaaactgctttttagtgcagacaagttttgttccagatgaatactggcagtctcttgaagtttcacatcacatggttttcaattatggttatttgacttgggaatggacagagagactgaggagttacacttatcccttaatctttgcaagcatttacaagattcttcatcttttagggaaagatagtgttcagttgctgatttggattcctagacttgcccaagcacttctgtctgctgtagcagatgtgagactttactcattaatgaagcaactagaaaatcaggaagtggcaagatgggtgtttttttgccagttgtgctcctggttcacatggtattgctgtaccagaacccttacaaacaccatggaaactgttctcactataattgctcttttctactatcctttggaaggttcaaagtctatgaacagtgtcaaatactcatccctggtggcacttgccttcataattcgtcccacagctgtcattctgtggacacctttgctcttcagacatttctgtcaagaaccaagaaagcttgatcttattctacatcattttttacctgtaggctttgttactttgagtttgtctctgatgattgatcgtattttttttggccaatggactctggttcaatttaattttttgaaatttaacgtgctgcagaactggggaacattttatggttctcatccatggcactggtacttcagtcaaggatttccagttatcttgggtactcacttacccttctttattcatggctgctatctagcaccaaagagataccggatacttttggtgactgtgctgtggacactgcttgtttatagcatgttgagccacaaagaattcaggtttatttatccagttttaccattctgtatggtgttctgtggatactcattaacccacctgaaaacatggaagaaaccagctctaagtttcctgtttttatcaaatttgttcctcgccctttatactggtttagttcatcaacgaggtactcttgatgtcatgagtcatattcaaaaagtttgttacaacaatcccaataaatcttcagcttcaatatttataatgatgccttgccactctactccttattacagccatgttcactgcccacttcccatgagatttctccagtgcccgccagacctgactggaaaaagtcattatcttgatgaagcagatgtattttacctaaatcccttaaactggttacatagagagtttcatgatgatgcatcattgcctactcacttgatcaccttcagcattttggaagaggtaagtaaacatgaaaaagaggaaaactcagtattttaattttaccccaggtttaggaaaccctcaggtaaatagataatataacctttttatggtctgtttcaacccacatttcataattagtcttttctccagtcaaaattagccccagttctgtaactatcaaagtattttacttcctataagttaattcttttattaagcaaaaagttgtagacagcaattagaataggcaattctaaaattgactgaaacagtactcagcaaaatgtagcctttatttacttaaacatttatttgcttctaggaaataagcgctttcctaatttcaagcaattataaaagaactgctgttttcttccacactcacttgccagagggtcgaattggaagtcacatatatgtctatgaacggaagttaaaagggaaattcaacatgaagatgaaattctgaactttcctagataaattaacattgctgggtggaaatattcagatgctgcttaaatacttcggtaaacactgggtaagattcatggaacttagaaaaaagctgtatgaactgctttaccaaatatcactactgaggaaatgtataaaataccacatagtataaaattacatgttaatacaatgccagattttaaataaagacctttagttttcctca

SEQ ID NO: 459126 - DNA, 2074 bp, Homo sapiens
cttttcgtcaaccccttgtggtgttgtcccttatgggtccatatgctgcctatttgctttccgtcgcttttggtgtcgctccttcggggggcctagggtcccgactgttttagattttggcaaaccttaggtttcagcaaatgacttcgtttaccctggaggtccaatttcccagggctgccactttactgccaaccgtagggtaggagcttccaagtgttcacatcgtcacaccactggaatttccatcgtgtgacgcagtcatcctgtatcccagctgctcgggagtctgggattacaggcgcatgccaccaagcctggctgatttttgtatttttagtagagacagggtttcaccatgttggtcaggctggtcttgaactcctgaccacctgatccacccgcctcggcctcccaaagtgctgggattacaggcgtgagccactgcgccaggcctaactccatgtagtattaacttttcttctcttctgattcttgtaccaactgcatcttttcttgttaattccttctgatctttggcatactgttcaaatactggttgaaaaatatatactcctccagcaattccaaggacagtggcaaaaagcagttgtgcaaaagtcaatctcctaaacattgctgcaacaaatacagctcaaggaaaagctggttttggaaagtcacactccacacccaggaaatctcttcaaatcgtttttaataaccactcaggtacctccgactgttctgcgcctgctccacgtcactaaactcgctaccgcctgctcccctccagagaccgggggccttccagcagttttcggacccccgagcacagagaccgccaagccaaaggcgagtagcaatccctcggttcggaaacggcgaaaggaaaccgcaaggaggccaccacgtcgggtgggagctacgaagttgcccgttcccggttacttccgggcttgcgagcgacgactgctctcaaaggccaaacttaatggatggacgagcagcgcgctactgcagctttcttccgccttaggaaggtggcggccagggatgaggaggcccctaagcaagtgcggaatggagccggggggcggagatgccagcctcactttgcatggtctccagaaccgctcccacggcaagataaagctgcgaaagagaaagtctaccttgtacttcaacacccaggagaagagcgccaggcgccgcggggatcttcttggagaaaatatttatctgctcttgtttaccatagctttacgaatattaaactgctttttagtgcagacaagttttgttccagatgaatactggcagtctcttgaagtttcacatcacatggttttcaattatggttatttgacttgggaatggacagagagactgaggagttacacttatcccttaatctttgcaagcatttacaagattcttcatcttttagggaaagatagtgttcagttgctgatttggattcctagacttgcccaagcacttctgtctgctgtagcagatgtgagactttactcattaatgaagcaactagaaaatcaggaagtggcaagatgggtggtaagtcctaaatactttagaagctgtatgccagttatttcgttcctatgggtataaagcacatggaaacattgattcccaaaacaattttagaagataattcatacaactttatagaggtacttccataaataagaacagtaatatgcaagtggcacctgccatatctttccttcggattaagccctgcacagtgtaagccactgatgccctcaaaccctatgagagtctaaaccctgggagacaacctttggaagccccttcactcctcaaaactgtccttgcctctctttccatagaattgagtagggatcgttctaaattaccagctacctcacaaagcatcttagctatttacaacccttgttctgttcctctagccagcctctatctgaggtgcagcccgagaaatctttttgcactgaaactctcacttctgaatgggatgttggaagtattaggttggtgcaaaagtaattgtcgtttgtgccacaac

SEQ ID NO: 459127 - DNA, 2622 bp, Homo sapiens
gtttccttccccctgaatcctggattcctctcaacctcctgttcatggtcttccaggaaggctgtttgcctgccttagtagttctgcttattcctagccagagaggggactgaagtggtcagatagggcaaagccagtgctcaatggctgctgtgggggcactaccctctgctccccaccactggtcctgccctttgcagacaacctaaagtcctcccttggccagagctctcccagtgttgatgctggcctggatgctgtgtgtctggaggctctttcacggaaggaggggtgttggaaaagaggaaaaggagcccagtgaggagctagaaggagaaaaggagaatgagggcaagtgggtgtggatatgcgtgtctgtgagtgcctgcctacccctctccaagcctgctgtctcttctgtatgtgcacgtgtctgtctcccagagaagctgtgctcagccagacagacggaaagggatcccagacttgggatctatgaatgagagcctcagactctgaagttgctcccagcgagatgcaccaggccccacggcaagagcgaaaaggcagcagcaagatgctgatggcgtgagaggtgtcaacatcagaggtgccagcatgaggaggatggcctcctctcccagcagggggcatgctgcagcccctgaagaccaccagccagagccctggtcagaaaccagtgtgattccattgccattcccctgtgaggcctggaaggagaggagtctgtctgaagaggagccactcaggccgccaagctgcctgggtgcccatccccagatcatgttgccccagctggggccctaccctgcccccaggtccctggcaccatgtgccccgcaggagcagacctccacatttaccctcctgcctttgggctgagagtctcccctccatcttccccatattcttgaggactctctgacacttggcagaaaccaggatctgttgggctgggcagtcaggttctttctccagcctcctctcctgtgagcatttcaagctggcgaggcactctgagccggaccctaccctgaggctggcagcatcccaggtgtgtggctgtgggagaggcctgtagccctcgctcactgctgtgttcttgcaccctgcagagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcaacccatggctacagcttgaaaggaggcccaaccaggctgctccaaccacaccccctgggccaactcccacctcaacccctccccacagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctccgcattttcctctttgcattgggttttcctgcattagtaactacagctgcaacagacatcctccacattgtgcacactggttttgcctttgtcctcaagagttgatacttggcattagcatgaaacttgtgggtgtgggaggatggagagagaactctaacacaaaacatcttattaaaattgtacttgagagacaaaaaaaaaactctgttgtattttgacagaattatttttattaaaatacacatccatgagca

SEQ ID NO: 459128 - DNA, 904 bp, Homo sapiens
tagcaaaggtggactgggacccggcagcgggtgccctgagagtcaaccactacagccgatttgaccccagttacatgggaataggactctcggctcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagactggatgctgggagggacgagatggggcgaggccatcggagaaacaacccagacagctactaacccagggatgctggagaaaacaacacgaacatccttcttcaatggcatcaaaggtagacggaaggaacagaggaaagaatggctgaacatggaacggaaaagagaaagacacggaagataaggaacagccaagaaaagcgccaaaagccacaaggaacagaaaaccgagaagacacacagcacacaaaacccgagaaagagccaagagcgaccaaga

SEQ ID NO: 459129 - DNA, 5773 bp, Homo sapiens
tagcaaaggtggactgggacccggcagcgggtgccctgagagtcaaccactacagccgatttgaccccagttacatgggaataggactctcggctcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcaacccatggctacagcttgaaaggaggcccaaccaggctgctccaaccacaccccctgggccaactcccacctcaacccctccccacagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcataagtaaaaaacaaatgagattatatatatatatataaaaatatatatattaaaaaaaaagacagtatttatcgtagcattagtggtccagcacctcttgggtgaggctgtccaggcaccatgttttctttgagtccaactcattaaaaaagaagaatctctgtcacctcagccaagtgatttattttttgctcccccttttttgagtcacaggccgagctgcagcctaggaaacccaaatagggtttggtgggccacttagtgggcatggttacattggtttatagcatcccaagaactgtagatccctaggcccctgagagctggacagagcagagaactacagggccaagggtccagagaagtgataacttggcccagggccacacagcagaggtagagggtccttggccagcacactatctaccactctaccccacctcccactgcctgccttgctcccctttcctcccttttcaataccctatcttcccttgttgttaagatggccaaataatacatttactctaaattgattgcctggaaactacctgccttcgtcctgagagcttctgtgtgtcaggctgctggaaagaagactccattcccaggacagaggcccttgagtacaggggctgctttcttcctgcctagatcttcaccatctctgcacagctctgagagaatggatgctttctgttgagaaaccagtaccttgtggaggcaggttcttgggctgctactccagggagtggatggaatccttggtcccctaggccagacttcactgccactgtgccagacagctccctgcagctgggccctagccactcttaggaaagactattgggagtatttgctggccagagaatgggactctatcagctttacacatgtcccaccagctgtttcagatagatccttacagctggcagagtaaaagtggtcccgctaccattggggaatcaggaaaggaaagactgagatggttgccaggacttggggtggcccacctgtggagaggactggctgccctggaggaggaaagggaggaagtctacacagaggagcaccaggacggctggaatttccatatgtgcttcacattgtgaggggagtgcacaagccgcccatgcaaagagtagggtcagccatggcaaggccggaagttgaactttcagtccctgcctgaatctgggctttgcaagctcctgctccatattggtggacatgggaatggttggtgtggcctgagatacccattgctcaccaggcctcactgggcccacagctgggcaacaagaaaaatgtttgaattggaccaactgctggtgatggggccagggccctgggccctgtgctgtcagaattctgccttgggaaatgatcctatagctgctgctttttcttggtccttggggctggcagacccatagaccatggcctgttaggaggcgtcctgtctgtaaaggaaattcatctcttgtgacagcctggggctacctagctcccaaacccagaagttggagacatcaggctgtttaaatgatcatagcctagcaggattggattaaaaccacaggcttttgcagctggaatggggttcagtgaacatctcccccattcctctcttgctacaaataaggaaacaggcccaggagattaagtgacttggctaaagtcacatagcaaattagtagcagagccgggactatcccttatccctgtgggttgggcaacactatttagtcctgaaaccgaatggcagataaaccccatgaggggtcaggctgatgtgccctccagcagtatctgagaagctgctaccttcaggggtgtgtcagggatgaggacgggtgcctgagcttaggttgtggagtggctgagagggcccaggagggctcgggacagctgtgtgctgcatggggttgggtgtctgcctggctcgcacttggtacccatggccacctccccattttctgtgccttatctcactgtttcagctgagtccaagttgtttactctgttcctctccagaggggctctctgtcccagttgggcagctcacctttgggacataagcctttgccccacaagctgtggagagggccaaaaccaagctgcttgagcccactctcttgctgagagtccaggcctgcctgcctgccagccagaggtgccccttatgcacatccagtcctaccagcctgcttccaggagcctagagtgggaaaggcacctgggggagccctggtgaagggctggacctgacccatggaggcaggaggaagacctggctttcttggtttgtccggccctggggagcagccttccctactcactttccccttgcggcaccaaatggtcactccttccagagcaaaaactggcactcatagcaagccagaacccccatccccatcctcatgggtctgtggctgggtgcaggccatcaaaatggacaccacgagacagaagtggggactgcctggccacctagcgccttcccactccttaagcaagcacaaagaagatgaggcagagaattgtcagagctgaaagttcctttggttgctcacaactcaggtatgcacccatgtggcagccaggcagcggagccctactagactgccagtctcatgcacccagacctgtggccagattgtggcctctggctgcctcaggcattttcctctttgcattgggttttcctgcattagtaactacagctgcaacagacatcctccacattgtgcacactggttttgcctttgtcctcaagagttgatacttggcattagcatgaaacttgtgggtgtgggaggatggagagagaactctaacacaaaacatcttattaaaattgtacttgagagacaaaaaaaaaactctgttgtattttgacagaattatttttattaaaatacacatccatgagcagtcatgtgtgtctggtctctgttttgagtcttactgaggttggcaccccttctgtgacacatcctgtcctaaaggatttgggcccttcccagcctctcaagtgcccaggccctcaggtgccttcttcaaggacctttgaaactgtgtatttgtaagaccccaaagaggacaggtacttaaacctcagttctctcttgaaacggctttcttcttatacaaggaaaaagtagcaaattcaactaaagagcctgggcacagtggctcacgcctataatctcagcacgttgggaggctgaggcaggtggatcccttgagctcaggagttcgagaacagcctgggcaacatggcaaaaccccatctctacaaaaaatacaaaaattagctgggcatgggggcgcattcctgtggtcccagctattcaggaggctgaggtgggaggatcactcgagcccaggaggtcaaggctgcagtgagttgagatcataccactgcactccggtctgggtgacagagtgagaccctgtctcaaaaaaaaaaaaaaaaaaaattcaactaaataaaggtgggccacaggaacttttccccacaaaaataaggtattaagaatacatttcagagccaggtgcagtggctcaccctgtaatcccagcactttgggaggccaaggcatgcagatcacctgaggtcaggagtttgagaccagcctagccaacatggtgaaaccccgtctctacaaaa

SEQ ID NO: 459130 - DNA, 5035 bp, Homo sapiens
tagcaaaggtggactgggacccggcagcgggtgccctgagagtcaaccactacagccgatttgaccccagttacatgggaataggactctcggctcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcaacccatggctacagcttgaaaggaggcccaaccaggctgctccaaccacaccccctgggccaactcccacctcaacccctccccacagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcataagtaaaaaacaaatgagattatatatatatatataaaaatatatatattaaaaaaaaagacagtatttatcgtagcattagtggtccagcacctcttgggtgaggctgtccaggcaccatgttttctttgagtccaactcattaaaaaagaagaatctctgtcacctcagccaagtgatttattttttgctcccccttttttgagtcacaggccgagctgcagcctaggaaacccaaatagggtttggtgggccacttagtgggcatggttacattggtttatagcatcccaagaactgtagatccctaggcccctgagagctggacagagcagagaactacagggccaagggtccagagaagtgataacttggcccagggccacacagcagaggtagagggtccttggccagcacactatctaccactctaccccacctcccactgcctgccttgctcccctttcctcccttttcaataccctatcttcccttgttgttaagatggccaaataatacatttactctaaattgattgcctggaaactacctgccttcgtcctgagagcttctgtgtgtcaggctgctggaaagaagactccattcccaggacagaggcccttgagtacaggggctgctttcttcctgcctagatcttcaccatctctgcacagctctgagagaatggatgctttctgttgagaaaccagtaccttgtggaggcaggttcttgggctgctactccagggagtggatggaatccttggtcccctaggccagacttcactgccactgtgccagacagctccctgcagctgggccctagccactcttaggaaagactattgggagtatttgctggccagagaatgggactctatcagctttacacatgtcccaccagctgtttcagatagatccttacagctggcagagtaaaagtggtcccgctaccattggggaatcaggaaaggaaagactgagatggttgccaggacttggggtggcccacctgtggagaggactggctgccctggaggaggaaagggaggaagtctacacagaggagcaccaggacggctggaatttccatatgtgcttcacattgtgaggggagtgcacaagccgcccatgcaaagagtagggtcagccatggcaaggccggaagttgaactttcagtccctgcctgaatctgggctttgcaagctcctgctccatattggtggacatgggaatggttggtgtggcctgagatacccattgctcaccaggcctcactgggcccacagctgggcaacaagaaaaatgtttgaattggaccaactgctggtgatggggccagggccctgggccctgtgctgtcagaattctgccttgggaaatgatcctatagctgctgctttttcttggtccttggggctggcagacccatagaccatggcctgttaggaggcgtcctgtctgtaaaggaaattcatctcttgtgacagcctggggctacctagctcccaaacccagaagttggagacatcaggctgtttaaatgatcatagcctagcaggattggattaaaaccacaggcttttgcagctggaatggggttcagtgaacatctcccccattcctctcttgctacaaataaggaaacaggcccaggagattaagtgacttggctaaagtcacatagcaaattagtagcagagccgggactatcccttatccctgtgggttgggcaacactatttagtcctgaaaccgaatggcagataaaccccatgaggggtcaggctgatgtgccctccagcagtatctgagaagctgctaccttcaggggtgtgtcagggatgaggacgggtgcctgagcttaggttgtggagtggctgagagggcccaggagggctcgggacagctgtgtgctgcatggggttgggtgtctgcctggctcgcacttggtacccatggccacctccccattttctgtgccttatctcactgtttcagctgagtccaagttgtttactctgttcctctccagaggggctctctgtcccagttgggcagctcacctttgggacataagcctttgccccacaagctgtggagagggccaaaaccaagctgcttgagcccactctcttgctgagagtccaggcctgcctgcctgccagccagaggtgccccttatgcacatccagtcctaccagcctgcttccaggagcctagagtgggaaaggcacctgggggagccctggtgaagggctggacctgacccatggaggcaggaggaagacctggctttcttggtttgtccggccctggggagcagccttccctactcactttccccttgcggcaccaaatggtcactccttccagagcaaaaactggcactcatagcaagccagaacccccatccccatcctcatgggtctgtggctgggtgcaggccatcaaaatggacaccacgagacagaagtggggactgcctggccacctagcgccttcccactccttaagcaagcacaaagaagatgaggcagagaattgtcagagctgaaagttcctttggttgctcacaactcaggtatgcacccatgtggcagccaggcagcggagccctactagtttttttctctcgcgcaaagaaaatcaaatcagcccctcccccaggaaaagttttatttttttttgggcttgggggaaaaggaaccaagttaatttaaaaccgctgcttgaaaagggggacacattgtgcacactggttttgcctttgtcctcaagagttgatacttggcattagcatgaaacttgtgggtgtgggaggatggagagagaactctaacacaaaacatcttattaaaattgtacttgagagacaaaaaaaaaactctgttgtattttgacagaattatttttattaaaatacacatccatgagca

SEQ ID NO: 459131 - DNA, 311 bp, Homo sapiens
tctggtatgttccttccgggtcactgatggttttggttcctgttaaccgcagcatgggatcattcctctgtggggctacatcagctactttggcagtcacctgctggactcacagccagactctgtctattggtggctctgctagaagccaagagtgctgacagaggtggggcaggctgaggagaggctgagagacctgggtgggcttctgtgacttgtcttgttcctccctcaagtacctactcagttattgctgctctcttcccccacaggttgggacaaacattcctatggttaccatggtgatgatg

SEQ ID NO: 459132 - DNA, 310 bp, Homo sapiens
gtcatggcaaaaatcacaaagatgcggcctcagtgcgtgccacccaccccatacctgctgcctgtggcatttattactttgaagtgaagattgtcagcaaaggaagagatgggtaagcccttcatgaccaccctctttccctgatcatggagctgatccctgtggtcagagttcaggtcctttggctggcacttgttgctgatgtgagctggggagccgcatgggtctgggctgccattatttcctgactgtgggcatggtctggtctaagcagcagatcttgatggccagtgggtgtgttgggggtaaa

SEQ ID NO: 459133 - DNA, 154 bp, Homo sapiens
gtttgacattgaggactacatgcgggagtggcgtgccaaggtccagggcacggtccactgcttccccatcagtgcccggcttggcgagtggcaggcagtgctgcagaagtgagtgccctgctcctgcccttacccactcccaccccaccccagc

SEQ ID NO: 459134 - DNA, 5225 bp, Homo sapiens
ccaagatggcggcagcgacggcagacccgggagctgggaacccgcagcctggggactcctccggcgggggcgctgggggcgggctgccgtcccctggggagcaggagctgagccggcgcttgcagcgcctgtatcccgcggtcaaccagcaagagactccgctgccgcgctcctggagccccaaggacaaatacaactacattggtctctcccagggcaacctccgcgtcactacaaaggtcatggcaaaaatcacaaagatgcggcctcagtgcgtgccacccaccccatacctgctgcctgtggcatttattactttgaagtgaagattgtcagcaaaggaagagatggttacatgggaataggactctcggctcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcataagtaaaaaacaaatgagattatatatatatatataaaaatatatatattaaaaaaaaagacagtatttatcgtagcattagtggtccagcacctcttgggtgaggctgtccaggcaccatgttttctttgagtccaactcattaaaaaagaagaatctctgtcacctcagccaagtgatttattttttgctcccccttttttgagtcacaggccgagctgcagcctaggaaacccaaatagggtttggtgggccacttagtgggcatggttacattggtttatagcatcccaagaactgtagatccctaggcccctgagagctggacagagcagagaactacagggccaagggtccagagaagtgataacttggcccagggccacacagcagaggtagagggtccttggccagcacactatctaccactctaccccacctcccactgcctgccttgctcccctttcctcccttttcaataccctatcttcccttgttgttaagatggccaaataatacatttactctaaattgattgcctggaaactacctgccttcgtcctgagagcttctgtgtgtcaggctgctggaaagaagactccattcccaggacagaggcccttgagtacaggggctgctttcttcctgcctagatcttcaccatctctgcacagctctgagagaatggatgctttctgttgagaaaccagtaccttgtggaggcaggttcttgggctgctactccagggagtggatggaatccttggtcccctaggccagacttcactgccactgtgccagacagctccctgcagctgggccctagccactcttaggaaagactattgggagtatttgctggccagagaatgggactctatcagctttacacatgtcccaccagctgtttcagatagatccttacagctggcagagtaaaagtggtcccgctaccattggggaatcaggaaaggaaagactgagatggttgccaggacttggggtggcccacctgtggagaggactggctgccctggaggaggaaagggaggaagtctacacagaggagcaccaggacggctggaatttccatatgtgcttcacattgtgaggggagtgcacaagccgcccatgcaaagagtagggtcagccatggcaaggccggaagttgaactttcagtccctgcctgaatctgggctttgcaagctcctgctccatattggtggacatgggaatggttggtgtggcctgagatacccattgctcaccaggcctcactgggcccacagctgggcaacaagaaaaatgtttgaattggaccaactgctggtgatggggccagggccctgggccctgtgctgtcagaattctgccttgggaaatgatcctatagctgctgctttttcttggtccttggggctggcagacccatagaccatggcctgttaggaggcgtcctgtctgtaaaggaaattcatctcttgtgacagcctggggctacctagctcccaaacccagaagttggagacatcaggctgtttaaatgatcatagcctagcaggattggattaaaaccacaggcttttgcagctggaatggggttcagtgaacatctcccccattcctctcttgctacaaataaggaaacaggcccaggagattaagtgacttggctaaagtcacatagcaaattagtagcagagccgggactatcccttatccctgtgggttgggcaacactatttagtcctgaaaccgaatggcagataaaccccatgaggggtcaggctgatgtgccctccagcagtatctgagaagctgctaccttcaggggtgtgtcagggatgaggacgggtgcctgagcttaggttgtggagtggctgagagggcccaggagggctcgggacagctgtgtgctgcatggggttgggtgtctgcctggctcgcacttggtacccatggccacctccccattttctgtgccttatctcactgtttcagctgagtccaagttgtttactctgttcctctccagaggggctctctgtcccagttgggcagctcacctttgggacataagcctttgccccacaagctgtggagagggccaaaaccaagctgcttgagcccactctcttgctgagagtccaggcctgcctgcctgccagccagaggtgccccttatgcacatccagtcctaccagcctgcttccaggagcctagagtgggaaaggcacctgggggagccctggtgaagggctggacctgacccatggaggcaggaggaagacctggctttcttggtttgtccggccctggggagcagccttccctactcactttccccttgcggcaccaaatggtcactccttccagagcaaaaactggcactcatagcaagccagaacccccatccccatcctcatgggtctgtggctgggtgcaggccatcaaaatggacaccacgagacagaagtggggactgcctggccacctagcgccttcccactccttaagcaagcacaaagaagatgaggcagagaattgtcagagctgaaagttcctttggttgctcacaactcaggtatgcacccatgtggcagccaggcagcggagccctactagactgccagtctcatgcacccagacctgtggccagattgtggcctctggctgcctcaggcattttcctctttgcattgggttttcctgcattagtaactacagctgcaacagacatcctccacattgtgcacactggttttgcctttgtcctcaagagttgatacttggcattagcatgaaacttgtgggtgtgggaggatggagagagaactctaacacaaaacatcttattaaaattgtacttgagagacaaaaaaaaaactctgttgtattttgacagaattatttttattaaaatacacatccatgagca

SEQ ID NO: 459135 - DNA, 5034 bp, Homo sapiens
tagcaaaggtggactgggacccggcagcgggtgccctgagagtcaaccactacagccgatttgaccccagttacatgggaataggactctcggctcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcaacccatggctacagcttgaaaggaggcccaaccaggctgctccaaccacaccccctgggccaactcccacctcaacccctccccacagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcataagtaaaaaacaaatgagattatatatatatatataaaaatatatatattaaaaaaaaagacagtatttatcgtagcattagtggtccagcacctcttgggtgaggctgtccaggcaccatgttttctttgagtccaactcattaaaaaagaagaatctctgtcacctcagccaagtgatttattttttgctcccccttttttgagtcacaggccgagctgcagcctaggaaacccaaatagggtttggtgggccacttagtgggcatggttacattggtttatagcatcccaagaactgtagatccctaggcccctgagagctggacagagcagagaactacagggccaagggtccagagaagtgataacttggcccagggccacacagcagaggtagagggtccttggccagcacactatctaccactctaccccacctcccactgcctgccttgctcccctttcctcccttttcaataccctatcttcccttgttgttaagatggccaaataatacatttactctaaattgattgcctggaaactacctgccttcgtcctgagagcttctgtgtgtcaggctgctggaaagaagactccattcccaggacagaggcccttgagtacaggggctgctttcttcctgcctagatcttcaccatctctgcacagctctgagagaatggatgctttctgttgagaaaccagtaccttgtggaggcaggttcttgggctgctactccagggagtggatggaatccttggtcccctaggccagacttcactgccactgtgccagacagctccctgcagctgggccctagccactcttaggaaagactattgggagtatttgctggccagagaatgggactctatcagctttacacatgtcccaccagctgtttcagatagatccttacagctggcagagtaaaagtggtcccgctaccattggggaatcaggaaaggaaagactgagatggttgccaggacttggggtggcccacctgtggagaggactggctgccctggaggaggaaagggaggaagtctacacagaggagcaccaggacggctggaatttccatatgtgcttcacattgtgaggggagtgcacaagccgcccatgcaaagagtagggtcagccatggcaaggccggaagttgaactttcagtccctgcctgaatctgggctttgcaagctcctgctccatattggtggacatgggaatggttggtgtggcctgagatacccattgctcaccaggcctcactgggcccacagctgggcaacaagaaaaatgtttgaattggaccaactgctggtgatggggccagggccctgggccctgtgctgtcagaattctgccttgggaaatgatcctatagctgctgctttttcttggtccttggggctggcagacccatagaccatggcctgttaggaggcgtcctgtctgtaaaggaaattcatctcttgtgacagcctggggctacctagctcccaaacccagaagttggagacatcaggctgtttaaatgatcatagcctagcaggattggattaaaaccacaggcttttgcagctggaatggggttcagtgaacatctcccccattcctctcttgctacaaataaggaaacaggcccaggagattaagtgacttggctaaagtcacatagcaaattagtagcagagccgggactatcccttatccctgtgggttgggcaacactatttagtcctgaaaccgaatggcagataaaccccatgaggggtcaggctgatgtgccctccagcagtatctgagaagctgctaccttcaggggtgtgtcagggatgaggacgggtgcctgagcttaggttgtggagtggctgagagggcccaggagggctcgggacagctgtgtgctgcatggggttgggtgtctgcctggctcgcacttggtacccatggccacctccccattttctgtgccttatctcactgtttcagctgagtccaagttgtttactctgttcctctccagaggggctctctgtcccagttgggcagctcacctttgggacataagcctttgccccacaagctgtggagagggccaaaaccaagctgcttgagcccactctcttgctgagagtccaggcctgcctgcctgccagccagaggtgccccttatgcacatccagtcctaccagcctgcttccaggagcctagagtgggaaaggcacctgggggagccctggtgaagggctggacctgacccatggaggcaggaggaagacctggctttcttggtttgtccggccctggggagcagccttccctactcactttccccttgcggcaccaaatggtcactccttccagagcaaaaactggcactcatagcaagccagaacccccatccccatcctcatgggtctgtggctgggtgcaggccatcaaaatggacaccacgagacagaagtggggactgcctggccacctagcgccttcccactccttaagcaagcacaaagaagatgaggcagagaattgtcagagctgaaagttcctttggttgctcacaactcaggtatgcacccatgtggcagccaggcagcggagccctactagactgccagtctcatgcacccagacctgtggccagattgtggcctctggctgcctcaggcattttcctctttgcattgggttttcctgcattagtaactacagctgcaacagacatcctccacattgtgcacactggttttgcctttgtcctcaagagttgatacttggcattagcatgaaacttgtgggtgtgggaggatggagagagaactctaacacaaaacatcttattaaaattgtacttgagagacaaaaaaaaaactctgttgtattttgacagaattatttttattaaaatacacatccatgagca

SEQ ID NO: 459136 - DNA, 5067 bp, Homo sapiens
tagcaaaggtggactgggacccggcagcgggtgccctgagagtcaaccactacagccgatttgaccccagttacatgggaataggactctcggctcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcaacccatggctacagcttgaaaggaggcccaaccaggctgctccaaccacaccccctgggccaactcccacctcaacccctccccacagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcataagtaaaaaacaaatgagattatatatatatatataaaaatatatatattaaaaaaaaagacagtatttatcgtagcattagtggtccagcacctcttgggtgaggctgtccaggcaccatgttttctttgagtccaactcattaaaaaagaagaatctctgtcacctcagccaagtgatttattttttgctcccccttttttgagtcacaggccgagctgcagcctaggaaacccaaatagggtttggtgggccacttagtgggcatggttacattggtttatagcatcccaagaactgtagatccctaggcccctgagagctggacagagcagagaactacagggccaagggtccagagaagtgataacttggcccagggccacacagcagaggtagagggtccttggccagcacactatctaccactctaccccacctcccactgcctgccttgctcccctttcctcccttttcaataccctatcttcccttgttgttaagatggccaaataatacatttactctaaattgattgcctggaaactacctgccttcgtcctgagagcttctgtgtgtcaggctgctggaaagaagactccattcccaggacagaggcccttgagtacaggggctgctttcttcctgcctagatcttcaccatctctgcacagctctgagagaatggatgctttctgttgagaaaccagtaccttgtggaggcaggttcttgggctgctactccagggagtggatggaatccttggtcccctaggccagacttcactgccactgtgccagacagctccctgcagctgggccctagccactcttaggaaagactattgggagtatttgctggccagagaatgggactctatcagctttacacatgtcccaccagctgtttcagatagatccttacagctggcagagtaaaagtggtcccgctaccattggggaatcaggaaaggaaagactgagatggttgccaggacttggggtggcccacctgtggagaggactggctgccctggaggaggaaagggaggaagtctacacagaggagcaccaggacggctggaatttccatatgtgcttcacattgtgaggggagtgcacaagccgcccatgcaaagagtagggtcagccatggcaaggccggaagttgaactttcagtccctgcctgaatctgggctttgcaagctcctgctccatattggtggacatgggaatggttggtgtggcctgagatacccattgctcaccaggcctcactgggcccacagctgggcaacaagaaaaatgtttgaattggaccaactgctggtgatggggccagggccctgggccctgtgctgtcagaattctgccttgggaaatgatcctatagctgctgctttttcttggtccttggggctggcagacccatagaccatggcctgttaggaggcgtcctgtctgtaaaggaaattcatctcttgtgacagcctggggctacctagctcccaaacccagaagttggagacatcaggctgtttaaatgatcatagcctagcaggattggattaaaaccacaggcttttgcagctggaatggggttcagtgaacatctcccccattcctctcttgctacaaataaggaaacaggcccaggagattaagtgacttggctaaagtcacatagcaaattagtagcagagccgggactatcccttatccctgtgggttgggcaacactatttagtcctgaaaccgaatggcagataaaccccatgaggggtcaggctgatgtgccctccagcagtatctgagaagctgctaccttcaggggtgtgtcagggatgaggacgggtgcctgagcttaggttgtggagtggctgagagggcccaggagggctcgggacagctgtgtgctgcatggggttgggtgtctgcctggctcgcacttggtacccatggccacctccccattttctgtgccttatctcactgtttcagctgagtccaagttgtttactctgttcctctccagaggggctctctgtcccagttgggcagctcacctttgggacataagcctttgccccacaagctgtggagagggccaaaaccaagctgcttgagcccactctcttgctgagagtccaggcctgcctgcctgccagccagaggtgccccttatgcacatccagtcctaccagcctgcttccaggagcctagagtgggaaaggcacctgggggagccctggtgaagggctggacctgacccatggaggcaggaggaagacctggctttcttggtttgtccggccctggggagcagccttccctactcactttccccttgcggcaccaaatggtcactccttccagagcaaaaactggcactcatagcaagccagaacccccatccccatcctcatgggtctgtggctgggtgcaggccatcaaaatggacaccacgagacagaagtggggactgcctggccacctagcgccttcccactccttaagcaagcacaaagaagatgaggcagagaattgtcagagctgaaagttcctttggttgctcacaactcaggtatgcacccatgtggcagccaggcagcggagccctactagactgccagtctcatgcacccagacctgtggccagattgtggcctctggctgcctcaggcattttcctctttgcattgggttttcctgcattagtaactacagctgcaacagacatcctccacattgtgcacactggttttgcctttgtcctcaagagttgatacttggcattagcatgaaacttgtgggtgtgggaggatgcaaacatacattaatgctgaaagttggaaccatcctggacattgtgcaacggctggaacacgctgtagacaacttacaaggctataagactgacaaaaagcacctagtgaccgaagagtatttgaccaaatatctgctgggcctg

SEQ ID NO: 459137 - DNA, 2643 bp, Homo sapiens
tagcaaaggtggactgggacccggcagcgggtgccctgagagtcaaccactacagccgatttgaccccagttacatgggaataggactctcggctcaaggcgtcaacatgaacagacttcctggttgggacaaacattcctatggttaccatggtgatgatgggcattcgttctgctcctcggggactggccagccctatggtcccacattcaccacaggagacgtgatcggctgctgtgtcaacctcatcaatggcacctgcttctacaccaagaatggccacagccttggtatagccttcacagacctcccggccaacctctaccccaccgtaggcctgcagacacctggggagattgtggacgccaactttgggcagcagcccttcctgtttgacattgaggactacatgcgggagtggcgtgccaaggtccagggcacggtccactgcttccccatcagtgcccggcttggcgagtggcaggcagtgctgcagaacatggtttcatcttacctcgtgcatcatgggtattgtgccacagccacggcttttgctcgaatgactgaaaccccgattcaggaagaacaggcgtccataaagaacagacaaaagatccagaagctggtgctggagggccgtgtgggcgaggccatcgagaccacccagcgcttctacccagggctgctggagcacaaccccaacctcctcttcatgctcaagtgccggcagtttgtggagatggtgaatgggacggacagtgaggtccgaagtttgagctcccgaagccccaagtcccaggacagctaccctggctcccccagcctcagtccccgacatggccccagtagttcccacatgcacaacacaggagcagacagtcccagctgtagcaatggcgtcgcgtccaccaagagcaaacagaaccacagtaaataccctgcacccagctcctcatcctcgtcctcctcctcctcctcgtcctcttccccatcctccgtcaattactccgagtccaactcaacagactccaccaagtcccagcaccacagcagtaccagtaaccaggagaccagcaacccatggctacagcttgaaaggaggcccaaccaggctgctccaaccacaccccctgggccaactcccacctcaacccctccccacagcgacagtgagatggagatggaggcagagcactaccccaacggtgtgctaggaagcatgtccacacgcattgttaatggtgcctacaagcatgaggacctgcagacggatgagtccagcatggatgacaggcatcctcggcggcagctctgcgggggcaaccaggctgccacagaaaggatcattctgtttggccgcgagttgcaggcattgagtgagcagttgggccgggagtacggcaagaatttggcccacacagagatgctgcaggatgccttcagcctgctggcatactcagacccctggagctgcccagttggccagcagcttgaccccatccagagggaacctgtgtgtgctgccctcaacagcgccattttagagtcccagaacctgccaaagcagccccctctgatgctcgccctgggccaggcatctgagtgtctccggctcatggcccgagcaggcctgggttcttgctcctttgccagagttgatgactacttgcactagctgactgtgctggctggctctggctggccctccactggccccagggctggagctgccctgccctccataggcaactggtgcagggactgggaaaccatagacagagtccactcctcctgcctggcctttccccctctccctttccttccttccttcctttctctgcccaccaccccgctcagtctctctctctctccccttcacgtgcagcggcctgtaacacagtattggctggttactctcatgtagcgccttctattttgaaaggggggttttgttttgaggaggggttggggtttttaaatttttttctcctgactgagccaccagtatttatctctggagagtttgtgctgagctggtttctgctaatttagtgatgaagcctatccaagttggtgatagcttattattttcataagtaaaaaacaaatgagattatatatatatatataaaaatatatatattaaaaaaaaagacagtatttatcgtagcattagtggtccagcacctcttgggtgaggctgtccaggcaccatgttttctttgagtccaactcattaaaaaagaagaatctctgtcacctcagccaagtgatttattttttgctcccccttttttgagtcacaggccgagctgcagcctaggaaacccaaatagggtttggtgggccacttagtgggcatggttacattggtttatagcatcccaagaactgtagatccctaggcccctgagagctggacagagcagagaactacagggccaagggtccagagaagtgataacttggcccagggccacacagcagaggtagagggtccttggccagcacactatctaccactctaccccacctcccactgcctgccttgctcccctttcctcccttttcaataccctatcttcccttgttgttaagatggccaaataatacatttactctaaattgattgcctggaaact

SEQ ID NO: 459138 - DNA, 918 bp, Homo sapiens
ctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatg

SEQ ID NO: 459139 - DNA, 1844 bp, Homo sapiens
ctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcagagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctcaaaaaaaaaaagcgggcgcaaaagatcccctgaggggccaggttagcgtaaccgcttctgtgcaagggcccataggaggggaaaagaagcacggcggtttcacctcggcggaccccctcggcctggaggcccttgcgggcatggccccccgatagcgggataatagtatggcctcccgtggtaccgaccgcc

SEQ ID NO: 459140 - DNA, 856 bp, Homo sapiens
ctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatg

SEQ ID NO: 459141 - DNA, 1597 bp, Homo sapiens
ctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcagagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcagtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctc

SEQ ID NO: 459142 - DNA, 1538 bp, Homo sapiens
ctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcagagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctc

SEQ ID NO: 459143 - DNA, 1596 bp, Homo sapiens
ctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatgggtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcagagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctc

SEQ ID NO: 459144 - DNA, 1073 bp, Homo sapiens
ctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcctttatcctctgatggttagccttgggatggagcatgaaggggatcctgttctatagaggggtgatcaa

SEQ ID NO: 459145 - DNA, 423 bp, Homo sapiens
gaacgagagaggaaggagtgggagggtgggacttaggaatgaagctttgagagtagtaggtggggaaccttaggatacacagtcaacatagggaaacaagaaattgagcaggtcgaagtattgagaaagctactttttctcttggtcttgttcatgcttatctctccttttcctttatttttctttcactcccagactatagaccagtttgaatatgatggttgtgacaattgtgatgcatatctacaaatgaagggtaaccgagagatggtatatgactgcactagctcttcctttgatgggtaagccgcttcagtttccatcattcacttctgcattacccaacctgcacccagagaagtaaatgcagggcaagtgttaatcctagttgggcccagccattcgtttttgggggttattttg

SEQ ID NO: 459146 - DNA, 1652 bp, Homo sapiens
ctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcagagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctc

SEQ ID NO: 459147 - DNA, 862 bp, Homo sapiens
ctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatgggtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatg

SEQ ID NO: 459148 - DNA, 2006 bp, Homo sapiens
ctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcagagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctcaaaaaaacaacaaaaaaaaattggtggggggcgctccgcgacccagaaaagttttcgaaaccatcgtcggggccgcgcgcacccgagaggtattgaaactgggccacaagggtggtccaaaagaaacctggggccgggaaagcgggggcgtctccccaaaaaaaaccgcgggggcaccggcggttggacacaccgagggggttggggcctcggggctcccacgggcacgagcatcatccccccgcgcgtgtgggtgaacaacaccgaagagcagataaaagagagaagaaaaagaaaaaagagaacagagaaaaagaagaagaaagcacgcaacaaagaacgaacagaagagag

SEQ ID NO: 459149 - DNA, 1695 bp, Homo sapiens
ctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaaggtgtcagtcggggacctggttgtagggcccatgggggaccaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcagagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctc

SEQ ID NO: 459150 - DNA, 1590 bp, Homo sapiens
ctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcagagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctc

SEQ ID NO: 459151 - DNA, 3611 bp, Homo sapiens
acggcgcgctgggctcacactgtcccgccgcggacgggctttgtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgcaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacatactttatacaaaatacagaatactttatattggaagtgaaagaaatgaacgtggacttttacacatgtgcatatttttctggaggctatatggattatttgaaatgaaaagcatactaattggactttaataaatcattttcaatcaaaaaaggtaa

SEQ ID NO: 459152 - DNA, 3557 bp, Homo sapiens
acggcgcgctgggctcacactgtcccgccgcggacgggctttgtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgcaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaagaaatgaacgtggacttttacacatgtgcatatttttctggaggctatatggattatttgaaatgaaaagcatactaattggactttaataaatcattttcaatcaaaaaaggtaa

SEQ ID NO: 459153 - DNA, 3499 bp, Homo sapiens
cctgaagccagcccgggggcggcaggagagggacgcgcggcggcagcgagcgcaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgcaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacatactttatacaaaatacagaatactttatattggaagtgaaagaaatgaacgtggacttttacacatgtgcatatttttctggaggctatatggattatttgaaatgaaaagcatactaattggactttaataaatcattttcaatcaaaaaaggtaa

SEQ ID NO: 459154 - DNA, 3600 bp, Homo sapiens
tcagccccgctgcggagcgcggcgctggactctatggggctggcagtgagagtggacgctgccgcggaggagaagcgcaagggtctcactcgttgctcaggctggagtacagtggtgccatcacagtatactgcaacctccacctcctgggctcaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgcaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacatactttatacaaaatacagaatactttatattggaagtgaaagaaatgaacgtggacttttacacatgtgcatatttttctggaggctatatggattatttgaaatgaaaagcatactaattggactttaataaatcattttcaatcaaaaaaggtaa

SEQ ID NO: 459155 - DNA, 3089 bp, Homo sapiens
acggcgcgctgggctcacactgtcccgccgcggacgggctttgtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgcaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatca

SEQ ID NO: 459156 - DNA, 2548 bp, Homo sapiens
cttagcgcccgaagcgagtctgtataagcgagagcgcacgccttgctgcatacactctcttaatttttcaccgctacagggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgcaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacatactttatacaaaatacagaatactttatattggaagtgaaagaaatgaacgtggacttttacacatgtgcatatttttctggaggctatatggattatttgaaatgaaaagcatactaattggactttaataaatcattttcaatcaaaaaaggtaa

SEQ ID NO: 459157 - DNA, 3713 bp, Homo sapiens
tcagctctccactgtggattattcaattcctttattatttaatggcaggatggcttttcccccgactcaccctcctcagctctgcaacttgaaactgtcttcccaaaacatctagctgggatgttggattcaaacctatgaaaattcctcaacttaagagtatttggacagatagcacagaagtcgtggcttttagaccttagcttttccctaccggctttctgtttgcattaagctagtatttgacacttgatgtctagggattcttacctcctttggccaatggtacttcacacccatatgctagtccttttatgctaaatgtgggttttcctgttgttttccaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgcaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacatactttatacaaaatacagaatactttatattggaagtgaaagaaatgaacgtggacttttacacatgtgcatatttttctggaggctatatggattatttgaaatgaaaagcatactaattggactttaataaatcattttcaatcaaaaaaggtaa

SEQ ID NO: 459158 - DNA, 3689 bp, Homo sapiens
acggcgcgctgggctcacactgtcccgccgcggacgggctttgtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgcaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacatactttatacaaaatacagaatactttatattggaagtgaaagaaatgaacgtggacttttacacatgtgcatatttttctggaggctatatggattatttgaaatgaaaagcatactaattggactttaataaatcattttcaatcaaaaaaggtaa

SEQ ID NO: 459159 - DNA, 3524 bp, Homo sapiens
tgttttagaaagcagggctgcatggtgtggggatgctgctgctactcattcctgctcattccagtgttctggaaaatgaggtggacgtctgatttatgaagctccccatccacctatctgagtacctgacttctcaggactgacacctacagcatcaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgcaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacatactttatacaaaatacagaatactttatattggaagtgaaagaaatgaacgtggacttttacacatgtgcatatttttctggaggctatatggattatttgaaatgaaaagcatactaattggactttaataaatcattttcaatcaaaaaaggtaa

SEQ ID NO: 459160 - DNA, 3361 bp, Homo sapiens
gtgtcatccttgaaggatagaataaatcagctgtcgtgttctcagtgaaaagtggaaagaagttttaaaggatctgcaaaatagaattatgagacagaggaaagaaagaaacagacaatctgatctctatcttcatcggccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatgcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatgtcatcttgtacttacacctttcatgcaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgtccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacatactttatacaaaatacagaatactttatattggaagtgaaagaaatgaacgtggacttttacacatgtgcatatttttctggaggctatatggattatttgaaatgaaaagcatactaattggactttaataaatcattttcaatcaaaaaaggtaa

SEQ ID NO: 459161 - DNA, 2607 bp, Homo sapiens
tcagctctccactgtggattattcaattcctttattatttaatggcaggatggcttttcccccgactcaccctcctcagctctgcaacttgaaactgtcttcccaaaacatctagctgggatgttggattcaaacctatgaaaattcctcaacttaagagtatttggacagatagcacagaagtcgtggcttttagaccttagcttttccctaccggctttctgtttgcattaagctagtatttgacacttgatgtctagggattcttacctcctttggccaatggtacttcacacccatatgctagtccttttatgctaaatgtgggttttcctgttgttttccaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccagttcacagccatgaatgaaccacagtgcttctacaacgagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgttagcacatggctccttcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgcgacaaagaaatgagcgccacctttaggcagatcctctgctgccagcgcagtgagaaccccaccggccccacagaaggctcagaccgctcggcttcctccctcaaccacaccatcttggctggagttcacagcaatgaccactctgtggtttagaacggaaactgagatgaggaaccagccgtcctctcttggaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttggagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcaaaaaaaaaaaaaaaaaaaaaaaaaaaaaaaaaaaaaaaaaaaaaaaaaaaaaaaaaaaaaaaaaaaaaaaaaaagagagaggaggggcgcgcgcccacaaattctccccccgcgaggaggagcccccacgacacggcacccccccgttttttgtcaacgaaggggcgccccctaagagagggagcgacgtatattaaataagcgcccgagagacgcgaggcggcgccgcggcgatataaccacaacgcgggggagcgagggagagaaaacaatgcgccagacgggagcatcctcgtgaggagaagaggcgccaccaaacaagggggggaggagcgaaaaatcaggtgggagcgaccaaccactccctctcccaccgagacgacgaatttattatacatacgcagccctcccgcgaggaaggaagcgaaacatcacaaagcgatccctatacgcacgaggagtgctactaacaggtgggtggttgtccccaccaccagccgtcgaaggcaatttataactactggccgggcgcgtcgaaaagaaaaactatcgtcgctgccacacgcgacggttagtacatcatcaccatgcagcaaccaccttttattcaccagcgcgggggga

SEQ ID NO: 459162 - DNA, 5140 bp, Homo sapiens
agtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctcaggagccgtccgccgccatccccaaggtcatgcagcagcagcagcagaccacccagcagcagctgccccagaaggtccaagcccaagtaatccaagagaccatcgtgcccaaagagcctcctcctgagtttgagttcattgctgatcctccctctatctcagccttcgacttggatgtggtgaagctgacggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagttaaataagacttgtctcggtcacctgtgccctgtccagactcgaggcagtggtaacactgcacagtgctatgtggcttctctttgaggatttttgggttttgtaactaaattcttgctgccctcatactttttatgtattagaatcatattcgtattgcccttttaaaacattgggatcctccaaaggcctgccccatgtatttaacagtaatacaggaagcatggcaggcaccatgcaaaccaaggatggatggtgcagtccctgtgtcagtgggcggtggtttcctgctggcctggaatcactcatcacctgattgattggctctgtggtcctgggcaggtgcctcataggtgtgtggatatgatgacgtttctttaaaatgtatgtatttaacaaatacttaattgtattaaggtcatgtaccaaggatttgataaagtttaaataatttactctctatctacttttatccattttatccattttaactcatgtaatcctcatgtgagtattcctgtttaacacttgagtaaactgaggcacagagaacataagttgcatgccatagtcacacactgtgaaagtgaaaagagaatgtgtgcaaaacacgtcacagtcctggtttctgagtaaaggcaggctgttatctttagaatcaagctatcacagggagataggcaatgctgtgggtgttggaggaaggtgagagcctgttgctaacaatttcctggttttaaagctaaggctgattttattgggaagatctcacatgtgtgtggcccctgagagttcccagtgccttttatttgcagtccttccatttggacctcctagctgccccatcaggtcatctccagggctcagaggggtgagaccatttcccaaggtcacagaaccagctctctagtcaccaccctgcctctccctctcacccagagtcagtaccagttttatggctttattacaaactgctgggtccctcccattttcaacttgattgatgggatgtcatcccttatcctgtctgacatttgcctctggcctggttgctagaagtttgccccaggggcaagagttgaaatttggcttcctgaggtgggctttgtggtttgcgtccctaaagtgagcccactactggttgcttgtccatggccaacaccagaaatcccctgagcactacctgggtctcattccaagaaggaagagggtcaggagaccttggggagtctcatattccaagttcttctttctttctgggagcagtgggcagttcatggtgttagggcactcacccccacagactggcaaaccctgcaggacttccgtggctgaggctgtgaccggaggccaggaatgccgttgggtggattgtgagtgaatgggccctttgagctgccctctagagagcaaatccagtttcctggagctcctgaatgaatatctgtactggctcgctcagatgcagaagctccattgaccatgaggccttgtgaacatcagtggccacaggcccagtgtgctgcttggcactgcactagtttaggacctgcagcatgtaggtagcgtcctagtgtttataatacaaagctgctctgcacagcttttctgattcttcttgcaatctcctgaggattatctgccccatttttaaaacgaggtggaatacccaaggtcatgtagccagtgagtgctctggaaagccaaagcagctcatcccttcctggggaccacactgctctgctccaccagaccacactatgaaataggaataagtgctcctgttgcaggactgctgggaaaacaggtggggtgggacttaagtcaccataattttgaagacttgcatgcagagggctccaggaattgtagacattaaggaatttcactttcagttctacccactacttaagtacttgtcatgtactcttagaggaggccagtaatgatcagaaccattttactttaaaattaataatattgtattagagaatatattaaatggttatattgggttatgttaggatatatacttgaatggaaatacatgtactattagcaatcatatttcatttatccctgtaattagacaagaaagcataatatagctctactcatgggtacacataccagtgtataagatttttagaagtttactttttaaaaataaaagcaaaatgtaagatcttaaaaaaaaaga

SEQ ID NO: 459163 - DNA, 2943 bp, Homo sapiens
agtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctcaggagccgtccgccgccatccccaaggtcatgcagcagcagcagcagaccacccagcagcagctgccccagaaggtccaagcccaagtaatccaagagaccatcgtgcccaaagagcctcctcctgagtttgagttcattgctgatcctccctctatctcagccttcgacttggatgtggtgaagctgacggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagtta

SEQ ID NO: 459164 - DNA, 3655 bp, Homo sapiens
agtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctcaggagccgtccgccgccatccccaaggtcatgcagcagcagcagcagaccacccagcagcagctgccccagaaggtccaagcccaagtaatccaagagaccatcgtgcccaaagagcctcctcctgagtttgagttcattgctgatcctccctctatctcagccttcgacttggatgtggtgaagctgacggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagttaaataagacttgtctcggtcacctgtgccctgtccagactcgaggcagtggtaacactgcacagtgctatgtggcttctctttgaggatttttgggttttgtaactaaattcttgctgccctcatactttttatgtattagaatcatattcgtattgcccttttaaaacattgggatcctccaaaggcctgccccatgtatttaacagtaatacaggaagcatggcaggcaccatgcaaaccaaggatggatggtgcagtccctgtgtcagtgggcggtggtttcctgctggcctggaatcactcatcacctgattgattggctctgtggtcctgggcaggtgcctcataggtgtgtggatatgatgacgtttctttaaaatgtatgtatttaacaaatacttaattgtattaaggtcatgtaccaaggatttgataaagtttaaataatttactctctaaaaaaaaaaaaggggggggtctaatatcctcgagggccagtagctaccaggttctgtcaagtggcctttaggagggattaagaggcaggggcggttaaagctgtgggaatgtgttggtctggaggacctctctcggctggctttgggaccaccacgaataagcccggattaaataggtgagtggacgttttggtgattgtcgtataaataaacacaaaatagacctacaacaagctcctaattcttcgcttgt

SEQ ID NO: 459165 - DNA, 3207 bp, Homo sapiens
agtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagttaaataagacttgtctcggtcacctgtgccctgtccagactcgaggcagtggtaacactgcacagtgctatgtggcttctctttgaggatttttgggttttgtaactaaattcttgctgccctcatactttttatgtattagaatcatattcgtattgcccttttaaaacattgggatcctccaaaggcctgccccatgtatttaacagtaatacaggaagcatggcaggcaccatgcaaaccaaggatggatggtgcagtccctgtgtcagtgggcggtggtttcctgctggcctggaatcactcatcacctgattgattggctctgtggtcctgggcaggtgcctcataggtgtgtggatatgatgacgtttctttaaaatgtatgtatttaacaaatacttaattgtattaaggtcatgtaccaaggatttgataaagtttaaataatttactctcta

SEQ ID NO: 459166 - DNA, 2851 bp, Homo sapiens
aagaaacctggagtccggatgcttcccaacataccacaactttctgctttgctctcagcctcaatatatctccctcttttccactctagctagaagacagaaggccagctcccaagcagatcagagggtggaattttcattctgtcccaactctgcacctgggtggaaccaggtgcaaatgccatagtttggaaccatacttccattctgttccgaaggaggcgctgactttgatgaaagccctggaggtggtagcctcatcaggagcagaccctgcttcagcgtagcaccaagctgtttcccatctctgcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagttaaataagacttgtctcggtcacctgtgccctgtccagactcgaggcagtggtaacactgcacagtgctatgtggcttctctttgaggatttttgggttttgtaactaaattcttgctgccctcatactttttatgtattagaatcatattcgtattgcccttttaaaacattgggatcctccaaaggcctgccccatgtatttaacagtaatacaggaagcatggcaggcaccatgcaaaccaaggatggatggtgcagtccctgtgtcagtgggcggtggtttcctgctggcctggaatcactcatcacctgattgattggctctgtggtcctgggcaggtgcctcataggtgtgtggatatgatgacgtttctttaaaatgtatgtatttaacaaatacttaattgtattaaggtcatgtaccaaggatttgataaagtttaaataatttactctcta

SEQ ID NO: 459167 - DNA, 2062 bp, Homo sapiens
ggatctctagacgtgatcatgtatgttgttgtcgcttggtactgggcgcgtacatatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagttaaataagacttgtctcggtcacctgtgccctgtccagactcgaggcagtggtaacactgcacagtgctatgtggcttctctttgaggatttttgggttttgtaactaaattcttgctgccctcatactttttatgtattagaatcatattcgtattgcccttttaaaacattgggatcctccaaaggcctgccccatgtatttaacagtaatacaggaagcatggcaggcaccatgcaaaccaaggatggatggtgcagtccctgtgtcagtgggcggtggtttcctgctggcctggaatcactcatcacctgattgattggctctgtggtcctgggcaggtgcctcataggtgtgtggatatgatgacgtttctttaaaatgtatgtatttaacaaatacttaattgtattaaggtcatgtaccaaggatttgataaagtttaaataatttactctcta

SEQ ID NO: 459168 - DNA, 536 bp, Homo sapiens
agtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctctttgggcacgatggtctcttggattacttgggcttgaccttctggggcagctgctgctgtgtctgctgctgctgctgca

SEQ ID NO: 459169 - DNA, 617 bp, Homo sapiens
  misc_feature (507)..(507): n is a, c, g, or t
agtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttntaaaggatggtataaaatgactctcaaccactttgtgaatacatatgtgtatataagaggttattgataaacttctgaggcagacatttgtctcgctttttttcaaaaaa

SEQ ID NO: 459170 - DNA, 391 bp, Homo sapiens
ctgctaatcctcgaagccacctttttaagttcatggtgccaactttgagtggtggtgccattattttggagaaggaaatcaagttactgaggttaagtaacttgccctaagtcccacagccaagtggagctgggattgggacacagaatcccatgcttcctcatctcctgtgctttatcacaggcccaggaaggctgcctctttgtactgcgttgtaaagcactgacagttgctttaactcttctgtatttcagatcttgattccacccaaaggtttattttcaaagctcaagaaagaggctgaaaacccccgagaagttttggatcagcaggtaaactgaatagcatttcttgcaaccagttactggtggttggttctgttttatgtctg

SEQ ID NO: 459171 - DNA, 3402 bp, Homo sapiens
agtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctcaggagccgtccgccgccatccccaaggtcatgcagcagcagcagcagaccacccagcagcagctgccccagaaggtccaagcccaagtaatccaagagaccatcgtgcccaaagagcctcctcctgagtttgagttcattgctgatcctccctctatctcagccttcgacttggatgtggtgaagctgacggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagttaaataagacttgtctcggtcacctgtgccctgtccagactcgaggcagtggtaacactgcacagtgctatgtggcttctctttgaggatttttgggttttgtaactaaattcttgctgccctcatactttttatgtattagaatcatattcgtattgcccttttaaaacattgggatcctccaaaggcctgccccatgtatttaacagtaatacaggaagcatggcaggcaccatgcaaaccaaggatggatggtgcagtccctgtgtcagtgggcggtggtttcctgctggcctggaatcactcatcacctgattgattggctctgtggtcctgggcaggtgcctcataggtgtgtggatatgatgacgtttctttaaaatgtatgtatttaacaaatacttaattgtattaaggtcatgtaccaaggatttgataaagtttaaataatttactctcta

SEQ ID NO: 459172 - DNA, 5086 bp, Homo sapiens
agtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctcaggagccgtccgccgccatccccaaggtcatgcagcagcagcagcagaccacccagcagcagctgccccagaaggtccaagcccaagtaatccaagagaccatcgtgcccaaagagcctcctcctgagtttgagttcattgctgatcctccctctatctcagccttcgacttggatgtggtgaagctgacggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagttaaataagacttgtctcggtcacctgtgccctgtccagactcgaggcagtggtaacactgcacagtgctatgtggcttctctttgaggatttttgggttttgtaactaaattcttgctgccctcatactttttatgtattagaatcatattcgtattgcccttttaaaacattgggatcctccaaaggcctgccccatgtatttaacagtaatacaggaagcatggcaggcaccatgcaaaccaaggatggatggtgcagtccctgtgtcagtgggcggtggtttcctgctggcctggaatcactcatcacctgattgattggctctgtggtcctgggcaggtgcctcataggtgtgtggatatgatgacgtttctttaaaatgtatgtatttaacaaatacttaattgtattaaggtcatgtaccaaggatttgataaagtttaaataatttactctctatctacttttatccattttatccattttaactcatgtaatcctcatgtgagtattcctgtttaacacttgagtaaactgaggcacagagaacataagttgcatgccatagtcacacactgtgaaagtgaaaagagaatgtgtgcaaaacacgtcacagtcctggtttctgagtaaaggcaggctgttatctttagaatcaagctatcacagggagataggcaatgctgtgggtgttggaggaaggtgagagcctgttgctaacaatttcctggttttaaagctaaggctgattttattgggaagatctcacatgtgtgtggcccctgagagttcccagtgccttttatttgcagtccttccatttggacctcctagctgccccatcaggtcatctccagggctcagaggggtgagaccatttcccaaggtcacagaaccagctctctagtcaccaccctgcctctccctctcacccagagtcagtaccagttttatggctttattacaaactgctgggtccctcccattttcaacttgattgatgggatgtcatcccttatcctgtctgacatttgcctctggcctggttgctagaattgcgtccctaaagtgagcccactactggttgcttgtccatggccaacaccagaaatcccctgagcactacctgggtctcattccaagaaggaagagggtcaggagaccttggggagtctcatattccaagttcttctttctttctgggagcagtgggcagttcatggtgttagggcactcacccccacagactggcaaaccctgcaggacttccgtggctgaggctgtgaccggaggccaggaatgccgttgggtggattgtgagtgaatgggccctttgagctgccctctagagagcaaatccagtttcctggagctcctgaatgaatatctgtactggctcgctcagatgcagaagctccattgaccatgaggccttgtgaacatcagtggccacaggcccagtgtgctgcttggcactgcactagtttaggacctgcagcatgtaggtagcgtcctagtgtttataatacaaagctgctctgcacagcttttctgattcttcttgcaatctcctgaggattatctgccccatttttaaaacgaggtggaatacccaaggtcatgtagccagtgagtgctctggaaagccaaagcagctcatcccttcctggggaccacactgctctgctccaccagaccacactatgaaataggaataagtgctcctgttgcaggactgctgggaaaacaggtggggtgggacttaagtcaccataattttgaagacttgcatgcagagggctccaggaattgtagacattaaggaatttcactttcagttctacccactacttaagtacttgtcatgtactcttagaggaggccagtaatgatcagaaccattttactttaaaattaataatattgtattagagaatatattaaatggttatattgggttatgttaggatatatacttgaatggaaatacatgtactattagcaatcatatttcatttatccctgtaattagacaagaaagcataatatagctctactcatgggtacacataccagtgtataagatttttagaagtttactttttaaaaataaaagcaaaatgtaagatcttaaaaaaaaaga

SEQ ID NO: 459173 - DNA, 4695 bp, Homo sapiens
agtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctcaggagccgtccgccgccatccccaaggtcatgcagcagcagcagcagaccacccagcagcagctgccccagaaggtccaagcccaagtaatccaagagaccatcgtgcccaaagagcctcctcctgagtttgagttcattgctgatcctccctctatctcagccttcgacttggatgtggtgaagctgacggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagttaaataagacttgtctcggtcacctgtgccctgtccagactcgaggcagtggtaacactgcacagtgctatgtggcttctctttgaggatttttgggttttgtaactaaattcttgctgccctcatactttttatgtattagaatcatattcgtattgcccttttaaaacattgggatcctccaaaggcctgccccatgtatttaacagtaatacaggaagcatggcaggcaccatgcaaaccaaggatggatggtgcagtccctgtgtcagtgggcggtggtttcctgctggcctggaatcactcatcacctgattgattggctctgtggtcctgggcaggtgcctcataggtgtgtggatatgatgacgtttctttaaaatgtatgtatttaacaaatacttaattgtattaaggtcatgtaccaaggatttgataaagtttaaataatttactctctatctacttttatccattttatccattttaactcatgtaatcctcatgtgagtattcctgtttaacacttgagtaaactgaggcacagagaacataagttgcatgccatagtcacacactgtgaaagtgaaaagagaatgtgtgcaaaacacgtcacagtcctggtttctgagtaaaggcaggctgttatctttagaatcaagctatcacagggagataggcaatgctgtgggtgttggaggaaggtgagagcctgttgctaacaatttcctggttttaaagctaaggctgattttattgggaagatctcacatgtgtgtggcccctgagagttcccagtgccttttatttgcagtccttccatttggacctcctagctgccccatcaggtcatctccagggctcagaggggtgagaccatttcccaaggtcacagaaccagctctctagtcaccaccctgcctctccctctcacccagagtcagtaccagttttatggctttattacaaactgctgggtccctcccattttcaacttgattgatgggatgtcatcccttatcctgtctgacatttgcctctggcctggttgctagaagtttgccccaggggcaagagttgaaatttggcttcctgaggtgggctttgtggtttgcgtccctaaagtgagcccactactggttgcttgtccatggccaacaccagaaatcccctgagcactacctgggtctcattccaagaaggaagagggtcaggagaccttggggagtctcatattccaagttcttctttctttctgggagcagtgggcagttcatggtgttagggcactcacccccacagactggcaaaccctgcaggacttccgtggctgaggctgtgaccggaggccaggaatgccgttgggtggattgtgagtgaatgggccctttgagctgccctctagagagcaaatccagaattgtagacattaaggaatttcactttcagttctacccactacttaagtacttgtcatgtactcttagaggaggccagtaatgatcagaaccattttactttaaaattaataatattgtattagagaatatattaaatggttatattgggttatgttaggatatatacttgaatggaaatacatgtactattagcaatcatatttcatttatccctgtaattagacaagaaagcataatatagctctactcatgggtacacataccagtgtataagatttttagaagtttactttttaaaaataaaagcaaaatgtaagatcttaaaaaaaaaga

SEQ ID NO: 459174 - DNA, 3686 bp, Homo sapiens
agtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctcaggagccgtccgccgccatccccaaggtcatgcagcagcagcagcagaccacccagcagcagctgccccagaaggtccaagcccaagtaatccaagagaccatcgtgcccaaagagcctcctcctgagtttgagttcattgctgatcctccctctatctcagccttcgacttggatgtggtgaagctgacggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagttaaataagacttgtctcggtcacctgtgccctgtccagactcgaggcagtggtaacactgcacagtgctatgtggcttctctttgaggatttttgggttttgtaactaaattcttgctgccctcatactttttatgtattagaatcatattcgtattgcccttttaaaacattgggatcctccaaaggcctgccccatgtatttaacagtaatacaggaagcatggcaggcaccatgcaaaccaaggatggatggtgcagtccctgtgtcagtgggcggtggtttcctgctggcctggaatcactcatcacctgattgattggctctgtggtcctgggcaggtgcctcataggtgtgtggatatgatgacgtttctttaaaatgtatgtatttaacaaatacttaattgtattaaggtcatgtaccaaggatttgataaagtttaaataatttactctctatctacttttatccattttatccattttaactcatgtaatcctcatgtgagtattcctgtttaacacttgagtaaactgaggcacagagaacaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcggccgaaaatccccccggggggggaaaaaccaccctttttaaaagggccccaatagtgggggtagtattaataaaaaaggagcgggggcgcgtttaa

SEQ ID NO: 459175 - DNA, 2356 bp, Homo sapiens
  misc_feature (2263)..(2264): n is a, c, g, or t
  misc_feature (2294)..(2294): n is a, c, g, or t
  misc_feature (2299)..(2299): n is a, c, g, or t
  misc_feature (2332)..(2332): n is a, c, g, or t
agtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctcaggagccgtccgccgccatccccaaggtcatgcagcagcagcagcagaccacccagcagcagctgccccagaaggtccaagcccaagtaatccaagagaccatcgtgcccaaagagcctcctcctgagtttgagttcattgctgatcctccctctatctcagccttcgacttggatgtggtgaagctgacggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaanncctgggtgccctgagtggtggtaaagtggngcaancccttcacgctccttggccatgttctgaacggnagcttgcctttgccttaataaatg

SEQ ID NO: 459176 - DNA, 918 bp, Homo sapiens
agtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctcaggagccgtccgccgccatccccaaggtcatgcagcagcagcagcagaccacccagcagcagctgccccagaaggtccaagcccaagtaatccaagagaccatcgtgcccaaagagcctcctcctgagtttgagttcattgctgatcctccctctatctcagccttcgacttggatgtggtgaagctgacggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcagccgaaaaagtttttgggatcaaggtgtggtttaccccaattgggaattggggcc

SEQ ID NO: 459177 - DNA, 447 bp, Homo sapiens
agtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactacctgggttagtctacctgggggataatc

SEQ ID NO: 459178 - DNA, 1677 bp, Homo sapiens
atacaacaactcctacagctttggtttatgaaatcagctagtcaacattagtagaaggtagtataaccagatggctcttcagaatctcatatttatgcaaatacagaataaaaggagttaaagaggaaaaatattacacacgtaacctgaaagcacaactgaaaaatattaaactgttatgaaaatctaaaaacataattaactccctgcaattttcttctctgattgcagcttatttgtctggaaatgtgtacatacacctcactgagagatgctgagatgactacagaaattaactttgagaccagaattacagagaagaaaaaccaaaacccaaccctgcatggtcaagtggtgctaacccaagactgtaacagggagaaatgcccagaatcatcaaaatagtgaaagactgatctgttcaaaatatttgctatatgcactgggtataatccgtaatccatacactgccagataatgccatttcaaggaaggatcgaatacttgatggtaaaggccaagtccccctgtattgggaagtgtgtgatttcggcagacctgctgggaaaatttagggtagagcactctttacagaagaactcaaaaacccaatttggataattttcattatctttttagcaaaatggtttcttaatgtttatattttattttcaaggttcattgtttaatgaaatattttattcttgcatttccataaggaaagggaaagtcatgatcatcctaaaggatcacagtttttaaaaggcaaacattttccctaaggaaacagacacaagctttcctagagaatatgatgttttttaggcattaataaggtccttttttataaaggacacttttctcctagtagttttgaattcaggaacagatccaaagttagcagtatatggctgctacatttccattttcattttcgagccatcagtttatgttcagatgccatctctgtaatcgcacatttaaaacataactgtagcctcactaatggaaaagtagtatgatgaacaatcattcccaatggtgtacaatgtaagggttttagggagcaacagtatttaactggaagaaagaattgcatatttaatgtagtctaatatatacacatttgtttaacatgtaaacaaaagtgttaaattcacatatacaacattatacaatttaatcactcttggaataaaattttatagccttttttctattgggaaaatttgtttagatgtgtgccactccataggtttatttccaaaatgaatgagcccaactccatttgtaaaaacttgtcagttagaattcctttttttagtggattagggctgaattcttagatccttatttcttttcactttaaatgctgccaaagatcactactcatcattcaggaattcgctgtctagcctatctgtagtttcctgaagattgaaaattatgtagactgctatttaaaaatatatttttctaagtgtgaggtttaagatgctgtattgaccctatgagtttttaatgtgttaattatctttatagcataatagatcgctttaggttcctggaatcccatttggtctgacaggatatatgaagattcttaatacctattttctgtgtctaatacttggttaatactaaaaatagaaatgactaaattacatcacagaaagc

SEQ ID NO: 459179 - DNA, 1629 bp, Homo sapiens
atctcattcaggaatcagtcttgttacaggagatgactttggcatggttaagttatttgacttcccatgtccagaaaaatttgcaaaacacaaaaggttcttgggtcattcgccccatgtgacaaatattcgatttaccagtggtgatcgacatgttgttagtgctggaggtgatgactgcagcttatttgtctggaaatgtgtacatacacctcactgagagatgctgagatgactacagaaattaactttgagaccagaattacagagaagaaaaaccaaaacccaaccctgcatggtcaagtggtgctaacccaagactgtaacagggagaaatgcccagaatcatcaaaatagtgaaagactgatctgttcaaaatatttgctatatgcactgggtataatccgtaatccatacactgccagataatgccatttcaaggaaggatcgaatacttgatggtaaaggccaagtccccctgtattgggaagtgtgtgatttcggcagacctgctgggaaaatttagggtagagcactctttacagaagaactcaaaaacccaatttggataattttcattatctttttagcaaaatggtttcttaatgtttatattttattttcaaggttcattgtttaatgaaatattttattcttgcatttccataaggaaagggaaagtcatgatcatcctaaaggatcacagtttttaaaaggcaaacattttccctaaggaaacagacacaagctttcctagagaatatgatgttttttaggcattaataaggtccttttttataaaggacacttttctcctagtagttttgaattcaggaacagatccaaagttagcagtatatggctgctacatttccattttcattttcgagccatcagtttatgttcagatgccatctctgtaatcgcacatttaaaacataactgtagcctcactaatggaaaagtagtatgatgaacaatcattcccaatggtgtacaatgtaagggttttagggagcaacagtatttaactggaagaaagaattgcatatttaatgtagtctaatatatacacatttgtttaacatgtaaacaaaagtgttaaattcacatatacaacattatacaatttaatcactcttggaataaaattttatagccttttttctattgggaaaatttgtttagatgtgtgccactccataggtttatttccaaaatgaatgagcccaactccatttgtaaaaacttgtcagttagaattcctttttttagtggattagggctgaattcttagatccttatttcttttcactttaaatgctgccaaagatcactactcatcattcaggaattcgctgtctagcctatctgtagtttcctgaagattgaaaattatgtagactgctatttaaaaatatatttttctaagtgtgaggtttaagatgctgtattgaccctatgagtttttaatgtgttaattatctttatagcataatagatcgctttaggttcctggaatcccatttggtctgacaggatatatgaagattcttaatacctattttctgtgtctaatacttggttaatactaaaaatagaaatgactaaattacatcacagaaagc

SEQ ID NO: 459180 - DNA, 1422 bp, Homo sapiens
  misc_feature (1238)..(1238): n is a, c, g, or t
atacaacaactcctacagctttggtttatgaaatcagctagtcaacattagtagaaggtagtataaccagatggctcttcagaatctcatatttatgcaaatacagaataaaaggagttaaagaggaaaaatattacacacgtaacctgaaagcacaactgaaaaatattaaactgttatgaaaatctaaaaacataattaactccctgcaattttcttctctgattgcagcttatttgtctggaaatgtgtacatacacctcactgagagatgctgagatgactacagaaattaactttgagaccagaattacagagaagaaaaaccaaaacccaaccctgcatggtcaagtggtgctaacccaagactgtaacagggagaaatgcccagaatcatcaaaatagtgaaagactgatctgttcaaaatatttgctatatgcactgggtataatccgtaatccatacactgccagataatgccatttcaaggaaggatcgaatacttgatggtaaaggccaagtccccctgtattgggaagtgtgtgatttcggcagacctgctgggaaaatttagggtagagcactctttacagaagaactcaaaaacccaatttggataattttcattatctttttagcaaaatggtttcttaatgtttatattttattttcaaggttcattgtttaatgaaatattttattcttgcatttccataaggaaagggaaagtcatgatcatcctaaaggatcacagtttttaaaaggcaaacattttccctaaggaaacagacacaagctttcctagagaatatgatgttttttaggcattaataaggtccttttttataaaggacacttttctcctagtagttttgaattcaggaacagatccaaagttagcagtatatggctgctacatttccattttcattttcgagccatcagtttatgttcagatgccatctctgtaatcgcacatttaaaacataactgtagcctcactaatggaaaagtagtatgatgaacaatcattcccaatggtgtacaatgtaagggttttagggagcaacagtatttaactggaagaaagaattgcatatttaatgtagtctaatatatacacatttgtttaacatgtaaacaaaagtgttaaattcacatatacaacattatacaatttaatcactcttggaataaaattttatagcctttcccttgggaaaatgggcggaggttngccaccaaggtattcccagtagtgacccaccctggtgaaacgcgtctgagaacctttgagggtagcggactaaaccttatccctaaggggcgacacacacagaaacggtacccacagtccaagaatgtagcggaaaacaagggggggacaccagtgagtcgagaccggagggtatagcacacgt

SEQ ID NO: 459181 - DNA, 1121 bp, Homo sapiens
tacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatga

SEQ ID NO: 459182 - DNA, 564 bp, Homo sapiens
cagttgatcaaatattctttgcccaaattacttttggttaaaatttctcctaaatgtgctacagagtgcaaactctgtctccctgccattccgctatatacttactaactattattttattcaagatcatgcatgctctacttgaaggtctatttctatcttttcaatgctacccttacccactagcctaatcacattattcctattttcaacatctaggaatcaattacatagtgaacatgcctaagaaataataatctgggcagatgcagtggctcaggcccgtaatcccagccctttgagaggccgagcgggtggatcacttgaggtcaggcgttggtcaagtgctcctagagaaccaggctgaccaacatggagaaaccttgtctctactaataatacaaaaattagccaggtgaagtggcaggcacctataatcccagctattcgggaggctgaggaaggagaattggttgaagcccggaggtggaggttgcagtgagccaatattgcgccactgcattccagacttggcaacagagtgacactccatctcaacaaaaa

SEQ ID NO: 459183 - DNA, 1065 bp, Homo sapiens
agaagggactgccttcccctcagtgctcgcccctccctagtgatcactcagtgcccctgagctcattcttttcagtaaattctctctctgcgtggtgagaaaacaggcctggagaggctctgcgacccgcttaggaccacagaactcgagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatga

SEQ ID NO: 459184 - DNA, 1202 bp, Homo sapiens
agaagggactgccttcccctcagtgctcgcccctccctagtgatcactcagtgcccctgagctcattcttttcagtaaattctctctctgcgtggtgagaaaacaggcctggagaggctctgcgacccgcttaggaccacagaactcggtactaggaaaactcctattttaaaatccagccctgggtgggaagatttgggaagaatcgttaatattgagagagagagggagaaagaggattagatgagagtggcgcctccgctcatgtccgccccctccccgcagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatga

SEQ ID NO: 459185 - DNA, 968 bp, Homo sapiens
tacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatga

SEQ ID NO: 459186 - DNA, 1072 bp, Homo sapiens
tacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatga

SEQ ID NO: 459187 - DNA, 495 bp, Homo sapiens
ccacagtgtaagtggtagagcccacattccactaggctgggcacacattatggagctccataatgtgtgcccacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatga

SEQ ID NO: 459188 - DNA, 940 bp, Homo sapiens
tacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagcatgaagatgcccactccacagatgatgagcaaagaccccaaaag

SEQ ID NO: 459189 - DNA, 986 bp, Homo sapiens
  misc_feature (678)..(678): n is a, c, g, or t
  misc_feature (682)..(682): n is a, c, g, or t
  misc_feature (697)..(697): n is a, c, g, or t
  misc_feature (700)..(700): n is a, c, g, or t
  misc_feature (707)..(708): n is a, c, g, or t
  misc_feature (714)..(715): n is a, c, g, or t
  misc_feature (720)..(722): n is a, c, g, or t
  misc_feature (724)..(724): n is a, c, g, or t
  misc_feature (728)..(728): n is a, c, g, or t
  misc_feature (731)..(732): n is a, c, g, or t
tacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccaggctggtgtgctccacttggcaggtntagncatctccctgtgggnggncatttcnngcacannaggannngnaagntcnngaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatga

SEQ ID NO: 459190 - DNA, 805 bp, Homo sapiens
tacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccaggtaagagccgaactgccattcttggagggtctggctcagggaacaattcctaggggacgttatctttaagggatcaaattctgagacaggctgcgggggctcctgccctaaggcagtgtcctctcttcccagctagagaaagaggttcatcccctataggatagcttgctaccctactggcctattctctctccaaggacatgggtacagtaaacagagagaggtgcccagtggtcagtatgcttgtctttggggaaaatgggaccaagaggtcctggataaccttggacagacaaggtttgcagagagagaagttggcaagtgcaggctcctgggcgtgttcatgtctgcatccagcctggaggggactcaggcagagagccctaagctggagtgtccaggctctgaggatcactgaggattcagtgctcacgaagaatgcctcttattccccagggtggagcaggagcccacatcccttggacaattaaggagagaagggagggagggggataggttttagcccctgaaggcattctcattaaaggtacttctcccagcctccccagaacttggttagggtactagagtgggttgcgac

SEQ ID NO: 459191 - DNA, 535 bp, Homo sapiens
tacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccctatggctaccagcgggggcctctccctccacccagacccactccccggccaccagttcccccatcgatgcccacttcgaggccctctccctcagtaaattcacattttccttcctcgtgttacattttcccaatatcttttctattccttggaccaatcagagatgctgtagctccttggggcaaaggtactaatccctggcagcagctgcactccattcccctttttaatgtaactttttccacaggaggtatttcttttttatgttggtcctgagtattttgcaaatgcacagagaaaataaaactaaactccttgttt

SEQ ID NO: 459192 - DNA, 1238 bp, Homo sapiens
tacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgactgtttgttttcctttaaaaatatgcaccaaatcatctctcatcacttttctctgagggttttagtagacagtaggagttaataaagaagttcattttggtttaaacataggaaaga

SEQ ID NO: 459193 - DNA, 1329 bp, Homo sapiens
tacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatgaaaaaaaaaaaaaaagaagcaaacacacacaaaaaaaaaacccggagggacacaaatggcggggggggcaaaaaagacgggcaaaaaaggcggcaaatggggccaaacagtggttgtccgaccccagtttctgtgacacaggcggacgaatgagaggaccaccccataagaagagggcgcaaaattccaaaagcccgggtacccggtag

SEQ ID NO: 459194 - DNA, 1031 bp, Homo sapiens
tacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatga

SEQ ID NO: 459195 - DNA, 1417 bp, Homo sapiens
tacttgggttcatggtctctaatatttcaaacaggagctccctttagcgagtccttcttttcctgactgcagctcttttcattttgccatccttttccagctccatgatggttctgcaggtttctgcggccccccggacagtggctctgacggcgttactgatggtgctgctcacatctgtggtccagggcagggccactccagagaattaccttttccagggacggcaggaatgctacgcgtttaatgggacacagcgcttcctggagagatacatctacaaccgggaggagttcgtgcgcttcgacagcgacgtgggggagttccgggcggtgacggagctggggcggcctgatgaggagtactggaacagccagaaggacatcctggaggagaagcgggcagtgccggacaggatgtgcagacacaactacgagctgggcgggcccatgaccctgcagcgccgagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggaaggcacagtctgattctgcccggagtaagacattgacgggagctgggggcttcgtgctggggctcatcatctgtggagtgggcatcttcatgcacaggaggagcaagaaagttcaacgaggatctgcataaacaggtaatattcctgctttgatttccttgtggggtgggttgcaggaggatatgagtcctttctgtgcattgtaacactgaggctcctccaggaagggaatctcaggcatgaacccctctttcaatgtcagccttcaggcaagtggggaaagagcattgcttggctccattgctgaaggaagcagagatcaactctgttatttatcagcctgagacgcatcctctcaccataatttttctctcctggacttacaggaaggaggctggcaacctgggataacttgtcttttacccccacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatga

SEQ ID NO: 459196 - DNA, 408 bp, Homo sapiens
  misc_feature (100)..(100): n is a, c, g, or t
  misc_feature (104)..(104): n is a, c, g, or t
  misc_feature (119)..(119): n is a, c, g, or t
  misc_feature (122)..(122): n is a, c, g, or t
  misc_feature (129)..(130): n is a, c, g, or t
  misc_feature (136)..(137): n is a, c, g, or t
  misc_feature (142)..(144): n is a, c, g, or t
  misc_feature (146)..(146): n is a, c, g, or t
  misc_feature (150)..(150): n is a, c, g, or t
  misc_feature (153)..(154): n is a, c, g, or t
agctcggtaccccaatgtcttactccgggcagaatcagactgtgccttccactccacggtgacaggactatccaggctggtgtgctccacttggcaggtntagncatctccctgtgggnggncatttcnngcacannaggannngnaagntcnngaggatctgcataaacagggttcctgagctcactgaaaagactattgtgccttaggaaaagcatttgctgtgtttcgttagcatctggctccaggacagaccttcaacttccaaattggatactgctgccaagaagttgctctgaagtcagtttctatcattctgctctttgattcaaagcactgtttctctcactgggcctccaaccatgttcccttcttcttagcaccacaaataatcaaaacccaacatga

SEQ ID NO: 459197 - DNA, 929 bp, Homo sapiens
cgttggtcaagtgctcctagagaaccaggctgaccaacatggagaaaccttgtctctactaataatacaaaaattagccaggtgaagtggcaggcacctataatcccagctattcgggaggctgaggaaggagaattggttgaagcccggaggtggaggttgcagtgagccaatattgcgccactgcattccagacttggcaacagagtgacactccatctcaacaaaaagaaagaatgaaagaaagaaagagcgagattatgtctcaaaaaaaaggaaggaaggaaggaaggaaggaaggaaggaaggaaggaaggaaagaaggacaatctcaaattctatttcattatttttcttccacgctcctagtccagcctagggtgaatgtttccccctccaagaaggggcccttgcagcaccacaacctgcttgtctgccacgtgacggatttctacccaggcagcattcaagtccgatggttcctgaatggacaggaggaaacagctggggtcgtgtccaccaacctgatccgtaatggagactggaccttccagatcctggtgatgctggaaatgaccccccagcagggagatgtctacacctgccaagtggagcacaccagcctggatagtcctgtcaccgtggagtggagtgagtctctgatgaccctctagaccccacctctgaagagcaggggactctctggctctggggtccactcatcttatcttctgcatctataccctggggccatgtccaaaccccatctttcttctataccagctcctgagcatagtttgaagccagggaaatggagacttcctgaccttggcttaggggttcctgaagattcatagttctcccccttgtcagagaatctagggacactgactggtctcgaaaccctcacacttaggaactgacctcac

SEQ ID NO: 459198 - DNA, 2123 bp, Homo sapiens
gaattccgcgctttgcagagaaagcccccctggctcttctctctcaatccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcgaaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaagtttcctgactttctgagaagccctggtttccccaaagaagtgatttctgatagaaatctgaaggtcatctccaagaaaaaagagatctagtatagtcaatgaattaaagacaagaaggtttccaatcagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagta

SEQ ID NO: 459199 - DNA, 272 bp, Homo sapiens
gcaggaactagttctctctctctctctcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagcaatgttgcatgctcacataattgaaaattaaaagtaacacatttttctgaaatgtaaaaaaaagataaa

SEQ ID NO: 459200 - DNA, 4220 bp, Homo sapiens
gaattccgcgctttgcagagaaagcccccctggctcttctctctcaatccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcgaaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaagtttcctgactttctgagaagccctggtttccccaaagaagtgatttctgatagaaatctgaaggtcatctccaagaaaaaagagatctagtatagtcaatgaattaaagacaagaaggtttccaatcagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagcagacaatgggagtccctttacaataacgagcccacttagctgtccttgagggcttagataccttgccacgtgaagtaggtagagcagcatttcaataggtaatttgtgtggttgtgccagaaactcagcccttctatgtaattacatacaggataaaaggtaagtctgctcacttctccttctacagggcatttcaactgactggaataagggcatggttgcatttagtactcaatcagatattactagaaaaaaaattaataatgtgagcctttccgagagcagaacgaggaaagattaaattttagaatgcttccttctgtctaatccatcaggggccaaaatgcccagtaaaattcaaacacatcacctattaatagacttacaagtgagaaaagaggttcctagggttattttaggcaatccctggtaaactgtttaaaccatcaaacccctacagtcagttttcagtatcctcatttaatattttaataggtttcttgtgaatttaaacttctcttctttcttaaggttgtgaaattccaaactgattttatgtgattttgaaaagtttagaaccagtgctgagtctatgtggagggtttatattcctatgtgatatactgttattaatgcatgtggtgccatgcttgtctttaaatatataaatagtgctaaattgcaaagtcatatggagctttggatttagtttgacttcttactactgctttgtctgctatattcaaacccaaaggcattcccaagctagggagataaaaattaattttctaaaatgtccacatcctatacatttgcttattcatggcatctttcaaattttattttagtttcctttatttgccaagaatacatatggatttgaatttttaaggagagaaggaaagggtaggaaaccagggccttgggtttagtaacaggcattggatgtctattaaccaactattcttacgctaatggctttgcagctcctattctcccatttgatcctcaaacaattctattagagtggtatttttatccaatttcacagattaaaatataagcactcaataaaatataacctttagaagcttaaaaagctagtaagtgatgaactgaggatttgaacccatgtttgtcaccaaggagctttccagggcacatgtcataaaattagagccaactgcagagctgtaagggaacttttagagatgaacttcttcagcctccatattttacagaaggaaactgaatcccagaaggagaaattgccgttctcaaggctccctggatgggtaataacacagatatgagtaggtcacataaagtatatcttttttaaaaaaaagaaattcaattatgtcttatttggggggtatatttcccagaagatatttttctggcatgtggtctgtaaacacagcatgattcatattttttatgtttcatgctactcatttgtttaattaccaacaaacatggggactttggctttttgacttatttgcaacaagcatgaaattgttaaatttaccttttatcaattgtaatcatcctatgccaacatattatcataaattcatagaaatatttttaaaaataaataacagacattgaaatccaattcttagataatactcccagaacagccaatggtaaatgccctatacttgagtcttacttagatgctgtggtaatgcaccattttagaagatgaatgatactgctatttctcttcagggaaacaataatggataaagaaatgtaactgccgggcagcaaagcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagcaatgttgcatgctcacataattgaaaattaaaagtaacacatttttctgaaatgtaaaaaaaagataaa

SEQ ID NO: 459201 - DNA, 4009 bp, Homo sapiens
tcatcgctgttccagacagcgatgactcgagagcgggggggcggaggctgctgctggcaggtggggcgcgggccggcgcgagctgaccgagcactcggcgggcgcggcgggactgcggcccgtggcggcgtgcgcggggacctgcgctgactaggtccggggaagtttcctgactttctgagaagccctggtttccccaaagaagtgatttctgatagaaatctgaaggtcatctccaagaaaaaagagatctagtatagtcaatgaattaaagacaagaaggtttccaatcagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagcagacaatgggagtccctttacaataacgagcccacttagctgtccttgagggcttagataccttgccacgtgaagtaggtagagcagcatttcaataggtaatttgtgtggttgtgccagaaactcagcccttctatgtaattacatacaggataaaaggtaagtctgctcacttctccttctacagggcatttcaactgactggaataagggcatggttgcatttagtactcaatcagatattactagaaaaaaaattaataatgtgagcctttccgagagcagaacgaggaaagattaaattttagaatgcttccttctgtctaatccatcaggggccaaaatgcccagtaaaattcaaacacatcacctattaatagacttacaagtgagaaaagaggttcctagggttattttaggcaatccctggtaaactgtttaaaccatcaaacccctacagtcagttttcagtatcctcatttaatattttaataggtttcttgtgaatttaaacttctcttctttcttaaggttgtgaaattccaaactgattttatgtgattttgaaaagtttagaaccagtgctgagtctatgtggagggtttatattcctatgtgatatactgttattaatgcatgtggtgccatgcttgtctttaaatatataaatagtgctaaattgcaaagtcatatggagctttggatttagtttgacttcttactactgctttgtctgctatattcaaacccaaaggcattcccaagctagggagataaaaattaattttctaaaatgtccacatcctatacatttgcttattcatggcatctttcaaattttattttagtttcctttatttgccaagaatacatatggatttgaatttttaaggagagaaggaaagggtaggaaaccagggccttgggtttagtaacaggcattggatgtctattaaccaactattcttacgctaatggctttgcagctcctattctcccatttgatcctcaaacaattctattagagtggtatttttatccaatttcacagattaaaatataagcactcaataaaatataacctttagaagcttaaaaagctagtaagtgatgaactgaggatttgaacccatgtttgtcaccaaggagctttccagggcacatgtcataaaattagagccaactgcagagctgtaagggaacttttagagatgaacttcttcagcctccatattttacagaaggaaactgaatcccagaaggagaaattgccgttctcaaggctccctggatgggtaataacacagatatgagtaggtcacataaagtatatcttttttaaaaaaaagaaattcaattatgtcttatttggggggtatatttcccagaagatatttttctggcatgtggtctgtaaacacagcatgattcatattttttatgtttcatgctactcatttgtttaattaccaacaaacatggggactttggctttttgacttatttgcaacaagcatgaaattgttaaatttaccttttatcaattgtaatcatcctatgccaacatattatcataaattcatagaaatatttttaaaaataaataacagacattgaaatccaattcttagataatactcccagaacagccaatggtaaatgccctatacttgagtcttacttagatgctgtggtaatgcaccattttagaagatgaatgatactgctatttctcttcagggaaacaataatggataaagaaatgtaactgccgggcagcaaagcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagcaatgttgcatgctcacataattgaaaattaaaagtaacacatttttctgaaatgtaaaaaaaagataaa

SEQ ID NO: 459202 - DNA, 3880 bp, Homo sapiens
tcatcgctgttccagacagcgatgactcgagagcgggggggcggaggctgctgctggcaggtggggcgcgggccggcgcgagctgaccgagcactcggcgggcgcggcgggactgcggcccgtggcggcgtgcgcggggacctgcgctgactaggtccggggaagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagcagacaatgggagtccctttacaataacgagcccacttagctgtccttgagggcttagataccttgccacgtgaagtaggtagagcagcatttcaataggtaatttgtgtggttgtgccagaaactcagcccttctatgtaattacatacaggataaaaggtaagtctgctcacttctccttctacagggcatttcaactgactggaataagggcatggttgcatttagtactcaatcagatattactagaaaaaaaattaataatgtgagcctttccgagagcagaacgaggaaagattaaattttagaatgcttccttctgtctaatccatcaggggccaaaatgcccagtaaaattcaaacacatcacctattaatagacttacaagtgagaaaagaggttcctagggttattttaggcaatccctggtaaactgtttaaaccatcaaacccctacagtcagttttcagtatcctcatttaatattttaataggtttcttgtgaatttaaacttctcttctttcttaaggttgtgaaattccaaactgattttatgtgattttgaaaagtttagaaccagtgctgagtctatgtggagggtttatattcctatgtgatatactgttattaatgcatgtggtgccatgcttgtctttaaatatataaatagtgctaaattgcaaagtcatatggagctttggatttagtttgacttcttactactgctttgtctgctatattcaaacccaaaggcattcccaagctagggagataaaaattaattttctaaaatgtccacatcctatacatttgcttattcatggcatctttcaaattttattttagtttcctttatttgccaagaatacatatggatttgaatttttaaggagagaaggaaagggtaggaaaccagggccttgggtttagtaacaggcattggatgtctattaaccaactattcttacgctaatggctttgcagctcctattctcccatttgatcctcaaacaattctattagagtggtatttttatccaatttcacagattaaaatataagcactcaataaaatataacctttagaagcttaaaaagctagtaagtgatgaactgaggatttgaacccatgtttgtcaccaaggagctttccagggcacatgtcataaaattagagccaactgcagagctgtaagggaacttttagagatgaacttcttcagcctccatattttacagaaggaaactgaatcccagaaggagaaattgccgttctcaaggctccctggatgggtaataacacagatatgagtaggtcacataaagtatatcttttttaaaaaaaagaaattcaattatgtcttatttggggggtatatttcccagaagatatttttctggcatgtggtctgtaaacacagcatgattcatattttttatgtttcatgctactcatttgtttaattaccaacaaacatggggactttggctttttgacttatttgcaacaagcatgaaattgttaaatttaccttttatcaattgtaatcatcctatgccaacatattatcataaattcatagaaatatttttaaaaataaataacagacattgaaatccaattcttagataatactcccagaacagccaatggtaaatgccctatacttgagtcttacttagatgctgtggtaatgcaccattttagaagatgaatgatactgctatttctcttcagggaaacaataatggataaagaaatgtaactgccgggcagcaaagcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagcaatgttgcatgctcacataattgaaaattaaaagtaacacatttttctgaaatgtaaaaaaaagataaa

SEQ ID NO: 459203 - DNA, 3813 bp, Homo sapiens
  misc_feature (3734)..(3734): n is a, c, g, or t
  misc_feature (3736)..(3736): n is a, c, g, or t
  misc_feature (3740)..(3742): n is a, c, g, or t
  misc_feature (3747)..(3747): n is a, c, g, or t
gaattccgcgctttgcagagaaagcccccctggctcttctctctcaatccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcgaaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaagtttcctgactttctgagaagccctggtttccccaaagaagtgatttctgatagaaatctgaaggtcatctccaagaaaaaagagatctagtatagtcaatgaattaaagacaagaaggtttccaatcagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagcagacaatgggagtccctttacaataacgagcccacttagctgtccttgagggcttagataccttgccacgtgaagtaggtagagcagcatttcaataggtaatttgtgtggttgtgccagaaactcagcccttctatgtaattacatacaggataaaaggtaagtctgctcacttctccttctacagggcatttcaactgactggaataagggcatggttgcatttagtactcaatcagatattactagaaaaaaaattaataatgtgagcctttccgagagcagaacgaggaaagattaaattttagaatgcttccttctgtctaatccatcaggggccaaaatgcccagtaaaattcaaacacatcacctattaatagacttacaagtgagaaaagaggttcctagggttattttaggcaatccctggtaaactgtttaaaccatcaaacccctacagtcagttttcagtatcctcatttaatattttaataggtttcttgtgaatttaaacttctcttctttcttaaggttgtgaaattccaaactgattttatgtgattttgaaaagtttagaaccagtgctgagtctatgtggagggtttatattcctatgtgatatactgttattaatgcatgtggtgccatgcttgtctttaaatatataaatagtgctaaattgcaaagtcatatggagctttggatttagtttgacttcttactactgctttgtctgctatattcaaacccaaaggcattcccaagctagggagataaaaattaattttctaaaatgtccacatcctatacatttgcttattcatggcatctttcaaattttattttagtttcctttatttgccaagaatacatatggatttgaatttttaaggagagaaggaaagggtaggaaaccagggccttgggtttagtaacaggcattggatgtctattaaccaactattcttacgctaatggctttgcagctcctattctcccatttgatcctcaaacaattctattagagtggtatttttatccaatttcacagattaaaatataagcactcaataaaatataacctttagaagcttaaaaagctagtaagtgatgaactgaggatttgaacccatgtttgtcaccaaggagctttccagggcacatgtcataaaattagagccaactgcagagctgtaagggaacttttagagatgaacttcttcagcctccatattttacagaaggaaactgaatcccagaaggagaaattgccgttctcaaggctccctggatgggtaataacacagatatgagtaggtcacataaagtatatcttttttaaaaaaaagaaattcaattatgtcttatttggggggtatatttcccagaagatatttttctggcatgtggtctgtaaacacagcatgattcatattttttatgtttcatgctactcatttgtttaattaccaacaaacatggggactttggctttttgacttattggacagctgaatggtattaccttttcatgtatatcttngntttnnnatctngaattttaatataggatggtgccttataattcaagacgggaggatggtaaaggggggaaaagaggt

SEQ ID NO: 459204 - DNA, 4223 bp, Homo sapiens
tcatcgctgttccagacagcgatgactcgagagcgggggggcggaggctgctgctggcaggtggggcgcgggccggcgcgagctgaccgagcactcggcgggcgcggcgggactgcggcccgtggcggcgtgcgcggggacctgcgctgactaggtccggggaaggtaattgtattagtctgttttcatgctgctgataaagatatacccgagtctgggaagaaaaagaggcttaattggacttacaattctacatggctggggaggcctcagaatcatggtgggaggcaaaaagcactcctttcatggcagcggcaagagacgatgaggaagaagcaaaagcggaaactcctgataaactcatcagatctcgtgagagtttcctgactttctgagaagccctggtttccccaaagaagtgatttctgatagaaatctgaaggtcatctccaagaaaaaagagatctagtatagtcaatgaattaaagacaagaaggtttccaatcagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagcagacaatgggagtccctttacaataacgagcccacttagctgtccttgagggcttagataccttgccacgtgaagtaggtagagcagcatttcaataggtaatttgtgtggttgtgccagaaactcagcccttctatgtaattacatacaggataaaaggtaagtctgctcacttctccttctacagggcatttcaactgactggaataagggcatggttgcatttagtactcaatcagatattactagaaaaaaaattaataatgtgagcctttccgagagcagaacgaggaaagattaaattttagaatgcttccttctgtctaatccatcaggggccaaaatgcccagtaaaattcaaacacatcacctattaatagacttacaagtgagaaaagaggttcctagggttattttaggcaatccctggtaaactgtttaaaccatcaaacccctacagtcagttttcagtatcctcatttaatattttaataggtttcttgtgaatttaaacttctcttctttcttaaggttgtgaaattccaaactgattttatgtgattttgaaaagtttagaaccagtgctgagtctatgtggagggtttatattcctatgtgatatactgttattaatgcatgtggtgccatgcttgtctttaaatatataaatagtgctaaattgcaaagtcatatggagctttggatttagtttgacttcttactactgctttgtctgctatattcaaacccaaaggcattcccaagctagggagataaaaattaattttctaaaatgtccacatcctatacatttgcttattcatggcatctttcaaattttattttagtttcctttatttgccaagaatacatatggatttgaatttttaaggagagaaggaaagggtaggaaaccagggccttgggtttagtaacaggcattggatgtctattaaccaactattcttacgctaatggctttgcagctcctattctcccatttgatcctcaaacaattctattagagtggtatttttatccaatttcacagattaaaatataagcactcaataaaatataacctttagaagcttaaaaagctagtaagtgatgaactgaggatttgaacccatgtttgtcaccaaggagctttccagggcacatgtcataaaattagagccaactgcagagctgtaagggaacttttagagatgaacttcttcagcctccatattttacagaaggaaactgaatcccagaaggagaaattgccgttctcaaggctccctggatgggtaataacacagatatgagtaggtcacataaagtatatcttttttaaaaaaaagaaattcaattatgtcttatttggggggtatatttcccagaagatatttttctggcatgtggtctgtaaacacagcatgattcatattttttatgtttcatgctactcatttgtttaattaccaacaaacatggggactttggctttttgacttatttgcaacaagcatgaaattgttaaatttaccttttatcaattgtaatcatcctatgccaacatattatcataaattcatagaaatatttttaaaaataaataacagacattgaaatccaattcttagataatactcccagaacagccaatggtaaatgccctatacttgagtcttacttagatgctgtggtaatgcaccattttagaagatgaatgatactgctatttctcttcagggaaacaataatggataaagaaatgtaactgccgggcagcaaagcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagcaatgttgcatgctcacataattgaaaattaaaagtaacacatttttctgaaatgtaaaaaaaagataaa

SEQ ID NO: 459205 - DNA, 4123 bp, Homo sapiens
tcatcgctgttccagacagcgatgactcgagagcgggggggcggaggctgctgctggcaggtggggcgcgggccggcgcgagctgaccgagcactcggcgggcgcggcgggactgcggcccgtggcggcgtgcgcggggacctgcgctgactaggtccggggaagattgggagtgtgcttttgaggaagaccacagagataaagggccattttgtcaagatgacttatcactgctgatgtcaaccttgatcacctggctgagatagtcgtcatcatcagtttcctgactttctgagaagccctggtttccccaaagaagtgatttctgatagaaatctgaaggtcatctccaagaaaaaagagatctagtatagtcaatgaattaaagacaagaaggtttccaatcagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagcagacaatgggagtccctttacaataacgagcccacttagctgtccttgagggcttagataccttgccacgtgaagtaggtagagcagcatttcaataggtaatttgtgtggttgtgccagaaactcagcccttctatgtaattacatacaggataaaaggtaagtctgctcacttctccttctacagggcatttcaactgactggaataagggcatggttgcatttagtactcaatcagatattactagaaaaaaaattaataatgtgagcctttccgagagcagaacgaggaaagattaaattttagaatgcttccttctgtctaatccatcaggggccaaaatgcccagtaaaattcaaacacatcacctattaatagacttacaagtgagaaaagaggttcctagggttattttaggcaatccctggtaaactgtttaaaccatcaaacccctacagtcagttttcagtatcctcatttaatattttaataggtttcttgtgaatttaaacttctcttctttcttaaggttgtgaaattccaaactgattttatgtgattttgaaaagtttagaaccagtgctgagtctatgtggagggtttatattcctatgtgatatactgttattaatgcatgtggtgccatgcttgtctttaaatatataaatagtgctaaattgcaaagtcatatggagctttggatttagtttgacttcttactactgctttgtctgctatattcaaacccaaaggcattcccaagctagggagataaaaattaattttctaaaatgtccacatcctatacatttgcttattcatggcatctttcaaattttattttagtttcctttatttgccaagaatacatatggatttgaatttttaaggagagaaggaaagggtaggaaaccagggccttgggtttagtaacaggcattggatgtctattaaccaactattcttacgctaatggctttgcagctcctattctcccatttgatcctcaaacaattctattagagtggtatttttatccaatttcacagattaaaatataagcactcaataaaatataacctttagaagcttaaaaagctagtaagtgatgaactgaggatttgaacccatgtttgtcaccaaggagctttccagggcacatgtcataaaattagagccaactgcagagctgtaagggaacttttagagatgaacttcttcagcctccatattttacagaaggaaactgaatcccagaaggagaaattgccgttctcaaggctccctggatgggtaataacacagatatgagtaggtcacataaagtatatcttttttaaaaaaaagaaattcaattatgtcttatttggggggtatatttcccagaagatatttttctggcatgtggtctgtaaacacagcatgattcatattttttatgtttcatgctactcatttgtttaattaccaacaaacatggggactttggctttttgacttatttgcaacaagcatgaaattgttaaatttaccttttatcaattgtaatcatcctatgccaacatattatcataaattcatagaaatatttttaaaaataaataacagacattgaaatccaattcttagataatactcccagaacagccaatggtaaatgccctatacttgagtcttacttagatgctgtggtaatgcaccattttagaagatgaatgatactgctatttctcttcagggaaacaataatggataaagaaatgtaactgccgggcagcaaagcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagcaatgttgcatgctcacataattgaaaattaaaagtaacacatttttctgaaatgtaaaaaaaagataaa

SEQ ID NO: 459206 - DNA, 3957 bp, Homo sapiens
tcatcgctgttccagacagcgatgactcgagagcgggggggcggaggctgctgctggcaggtggggcgcgggccggcgcgagctgaccgagcactcggcgggcgcggcgggactgcggcccgtggcggcgtgcgcggggacctgcgctgactaggtccggggaagtttcctgactttctgagaagccctggtttccccaaagaagtgatttctgatagaaatctgaaggtcatctccaagaatccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagcagacaatgggagtccctttacaataacgagcccacttagctgtccttgagggcttagataccttgccacgtgaagtaggtagagcagcatttcaataggtaatttgtgtggttgtgccagaaactcagcccttctatgtaattacatacaggataaaaggtaagtctgctcacttctccttctacagggcatttcaactgactggaataagggcatggttgcatttagtactcaatcagatattactagaaaaaaaattaataatgtgagcctttccgagagcagaacgaggaaagattaaattttagaatgcttccttctgtctaatccatcaggggccaaaatgcccagtaaaattcaaacacatcacctattaatagacttacaagtgagaaaagaggttcctagggttattttaggcaatccctggtaaactgtttaaaccatcaaacccctacagtcagttttcagtatcctcatttaatattttaataggtttcttgtgaatttaaacttctcttctttcttaaggttgtgaaattccaaactgattttatgtgattttgaaaagtttagaaccagtgctgagtctatgtggagggtttatattcctatgtgatatactgttattaatgcatgtggtgccatgcttgtctttaaatatataaatagtgctaaattgcaaagtcatatggagctttggatttagtttgacttcttactactgctttgtctgctatattcaaacccaaaggcattcccaagctagggagataaaaattaattttctaaaatgtccacatcctatacatttgcttattcatggcatctttcaaattttattttagtttcctttatttgccaagaatacatatggatttgaatttttaaggagagaaggaaagggtaggaaaccagggccttgggtttagtaacaggcattggatgtctattaaccaactattcttacgctaatggctttgcagctcctattctcccatttgatcctcaaacaattctattagagtggtatttttatccaatttcacagattaaaatataagcactcaataaaatataacctttagaagcttaaaaagctagtaagtgatgaactgaggatttgaacccatgtttgtcaccaaggagctttccagggcacatgtcataaaattagagccaactgcagagctgtaagggaacttttagagatgaacttcttcagcctccatattttacagaaggaaactgaatcccagaaggagaaattgccgttctcaaggctccctggatgggtaataacacagatatgagtaggtcacataaagtatatcttttttaaaaaaaagaaattcaattatgtcttatttggggggtatatttcccagaagatatttttctggcatgtggtctgtaaacacagcatgattcatattttttatgtttcatgctactcatttgtttaattaccaacaaacatggggactttggctttttgacttatttgcaacaagcatgaaattgttaaatttaccttttatcaattgtaatcatcctatgccaacatattatcataaattcatagaaatatttttaaaaataaataacagacattgaaatccaattcttagataatactcccagaacagccaatggtaaatgccctatacttgagtcttacttagatgctgtggtaatgcaccattttagaagatgaatgatactgctatttctcttcagggaaacaataatggataaagaaatgtaactgccgggcagcaaagcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagcaatgttgcatgctcacataattgaaaattaaaagtaacacatttttctgaaatgtaaaaaaaagataaa

SEQ ID NO: 459207 - DNA, 2155 bp, Homo sapiens
gaattccgcgctttgcagagaaagcccccctggctcttctctctcaatccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcgaaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaagtttcctgactttctgagaagccctggtttccccaaagaagtgatttctgatagaaatctgaaggtcatctccaagaaaaaagagatctagtatagtcaatgaattaaagacaagaaggtttccaatcagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagta

SEQ ID NO: 459208 - DNA, 3092 bp, Homo sapiens
  misc_feature (65)..(65): n is a, c, g, or t
  misc_feature (67)..(67): n is a, c, g, or t
gagagagagagagagagagagagagagagagagagagagagagagagagagagagagagagagangnggaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagcagacaatgggagtccctttacaataacgagcccacttagctgtccttgagggcttagataccttgccacgtgaagtaggtagagcagcatttcaataggtaatttgtgtggttgtgccagaaactcagcccttctatgtaattacatacaggataaaaggtaagtctgctcacttctccttctacagggcatttcaactgactggaataagggcatggttgcatttagtactcaatcagatattactagaaaaaaaattaataatgtgagcctttccgagagcagaacgaggaaagattaaattttagaatgcttccttctgtctaatccatcaggggccaaaatgcccagtaaaattcaaacacatcacctattaatagacttacaagtgagaaaagaggttcctagggttattttaggcaatccctggtaaactgtttaaaccatcaaacccctacagtcagttttcagtatcctcatttaatattttaataggtttcttgtgaatttaaacttctcttctttcttaaggttgtgaaattccaaactgattttatgtgattttgaaaagtttagaaccagtgctgagtctatgtggagggtttatattcctatgtgatatactgttattaatgcatgtggtgccatgcttgtctttaaatatataaatagtgctaaattgcaaagtcatatggagctttggatttagtttgacttcttactactgctttgtctgctatattcaaacccaaaggcattcccaagctagggagataaaaattaattttctaaaatgtccacatcctatacatttgcttattcatggcatctttcaaattttattttagtttcctttatttgccaagaatacatatggatttgaatttttaaggagagaaggaaagggtaggaaaccagggccttgggtttagtaacaggcattggatgtctattaaccaactattcttacgctaatggctttgcagctcctattctcccatttgatcctcaaacaattctattagagtggtatttttatccaatttcacagattaaaatataagcactcaataaaatataacctttagaagcttaaaaagctagtaagtgatgaactgaggatttgaacccatgtttgtcaccaaggagctttccagggcacatgtcataaaattagagccaactgcagagctgtaagggaacttttagagatgaacttcttcagcctccatattttacagaaggaaactgaatcccagaaggagaaattgccgttctcaaggctccctggatgggtaataacacagatatgagtaggtcacataaagtatatcttttttaaaaaaaagaaattcaattatgtcttatttggggggtatatttcccagaagatatttttctggcatgtggtctgtaaacacagcatgattcatattttttatgtttcatgctactcatttgtttaattaccaacaaacatggggactttggctttttgacttatttgcaacaagcatgaaattgttaaatttaccttttatcaattgtaatcatcctatgccaacatattatcataaattcatagaaatatttttaaaaataaataacagacattgaaatccaattcttagataatactcccagaacagccaatggtaaatgccctatacttgagtcttacttagatgctgtggtaatgcaccattttagaagatgaatgatactgctatttctcttcagggaaacaataatggataaagaaatgtaactgccgggcagcaaagcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagcaatgttgcatgctcacataattgaaaattaaaagtaacacatttttctgaaatgtaaaaaaaagataaa

SEQ ID NO: 459209 - DNA, 4162 bp, Homo sapiens
gaattccgcgctttgcagagaaagcccccctggctcttctctctcaatccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcgaaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaagtttcctgactttctgagaagccctggtttccccaaagaagtgatttctgatagaaatctgaaggtcatctccaagaaaaaagagatctagtatagtcaatgaattaaagacaagaaggtttccaatcagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagcagacaatgggagtccctttacaataacgagcccacttagctgtccttgagggcttagataccttgccacgtgaagtaggtagagcagcatttcaataggtaatttgtgtggttgtgccagaaactcagcccttctatgtaattacatacaggataaaaggtaagtctgctcacttctccttctacagggcatttcaactgactggaataagggcatggttgcatttagtactcaatcagatattactagaaaaaaaattaataatgtgagcctttccgagagcagaacgaggaaagattaaattttagaatgcttccttctgtctaatccatcaggggccaaaatgcccagtaaaattcaaacacatcacctattaatagacttacaagtgagaaaagaggttcctagggttattttaggcaatccctggtaaactgtttaaaccatcaaacccctacagtcagttttcagtatcctcatttaatattttaataggtttcttgtgaatttaaacttctcttctttcttaaggttgtgaaattccaaactgattttatgtgattttgaaaagtttagaaccagtgctgagtctatgtggagggtttatattcctatgtgatatactgttattaatgcatgtggtgccatgcttgtctttaaatatataaatagtgctaaattgcaaagtcatatggagctttggatttagtttgacttcttactactgctttgtctgctatattcaaacccaaaggcattcccaagctagggagataaaaattaattttctaaaatgtccacatcctatacatttgcttattcatggcatctttcaaattttattttagtttcctttatttgccaagaatacatatggatttgaatttttaaggagagaaggaaagggtaggaaaccagggccttgggtttagtaacaggcattggatgtctattaaccaactattcttacgctaatggctttgcagctcctattctcccatttgatcctcaaacaattctattagagtggtatttttatccaatttcacagattaaaatataagcactcaataaaatataacctttagaagcttaaaaagctagtaagtgatgaactgaggatttgaacccatgtttgtcaccaaggagctttccagggcacatgtcataaaattagagccaactgcagagctgtaagggaacttttagagatgaacttcttcagcctccatattttacagaaggaaactgaatcccagaaggagaaattgccgttctcaaggctccctggatgggtaataacacagatatgagtaggtcacataaagtatatatatttttctggcatgtggtctgtaaacacagcatgattcatattttttatgtttcatgctactcatttgtttaattaccaacaaacatggggactttggctttttgacttatttgcaacaagcatgaaattgttaaatttaccttttatcaattgtaatcatcctatgccaacatattatcataaattcatagaaatatttttaaaaataaataacagacattgaaatccaattcttagataatactcccagaacagccaatggtaaatgccctatacttgagtcttacttagatgctgtggtaatgcaccattttagaagatgaatgatactgctatttctcttcagggaaacaataatggataaagaaatgtaactgccgggcagcaaagcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagcaatgttgcatgctcacataattgaaaattaaaagtaacacatttttctgaaatgtaaaaaaaagataaa

SEQ ID NO: 459210 - DNA, 3769 bp, Homo sapiens
caacttctagaatccatcgatgtggaacacttcagtttgtttaacgtaggagactccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagcagacaatgggagtccctttacaataacgagcccacttagctgtccttgagggcttagataccttgccacgtgaagtaggtagagcagcatttcaataggtaatttgtgtggttgtgccagaaactcagcccttctatgtaattacatacaggataaaaggtaagtctgctcacttctccttctacagggcatttcaactgactggaataagggcatggttgcatttagtactcaatcagatattactagaaaaaaaattaataatgtgagcctttccgagagcagaacgaggaaagattaaattttagaatgcttccttctgtctaatccatcaggggccaaaatgcccagtaaaattcaaacacatcacctattaatagacttacaagtgagaaaagaggttcctagggttattttaggcaatccctggtaaactgtttaaaccatcaaacccctacagtcagttttcagtatcctcatttaatattttaataggtttcttgtgaatttaaacttctcttctttcttaaggttgtgaaattccaaactgattttatgtgattttgaaaagtttagaaccagtgctgagtctatgtggagggtttatattcctatgtgatatactgttattaatgcatgtggtgccatgcttgtctttaaatatataaatagtgctaaattgcaaagtcatatggagctttggatttagtttgacttcttactactgctttgtctgctatattcaaacccaaaggcattcccaagctagggagataaaaattaattttctaaaatgtccacatcctatacatttgcttattcatggcatctttcaaattttattttagtttcctttatttgccaagaatacatatggatttgaatttttaaggagagaaggaaagggtaggaaaccagggccttgggtttagtaacaggcattggatgtctattaaccaactattcttacgctaatggctttgcagctcctattctcccatttgatcctcaaacaattctattagagtggtatttttatccaatttcacagattaaaatataagcactcaataaaatataacctttagaagcttaaaaagctagtaagtgatgaactgaggatttgaacccatgtttgtcaccaaggagctttccagggcacatgtcataaaattagagccaactgcagagctgtaagggaacttttagagatgaacttcttcagcctccatattttacagaaggaaactgaatcccagaaggagaaattgccgttctcaaggctccctggatgggtaataacacagatatgagtaggtcacataaagtatatcttttttaaaaaaaagaaattcaattatgtcttatttggggggtatatttcccagaagatatttttctggcatgtggtctgtaaacacagcatgattcatattttttatgtttcatgctactcatttgtttaattaccaacaaacatggggactttggctttttgacttatttgcaacaagcatgaaattgttaaatttaccttttatcaattgtaatcatcctatgccaacatattatcataaattcatagaaatatttttaaaaataaataacagacattgaaatccaattcttagataatactcccagaacagccaatggtaaatgccctatacttgagtcttacttagatgctgtggtaatgcaccattttagaagatgaatgatactgctatttctcttcagggaaacaataatggataaagaaatgtaactgccgggcagcaaagcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagcaatgttgcatgctcacataattgaaaattaaaagtaacacatttttctgaaatgtaaaaaaaagataaa

SEQ ID NO: 459211 - DNA, 1359 bp, Homo sapiens
gaattccgcgctttgcagagaaagcccccctggctcttctctctcaatccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcgaaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaagtttcctgactttctgagaagccctggtttccccaaagaagtgatttctgatagaaatctgaaggtcatctccaagaaaaaagagatctagtatagtcaatgaattaaagacaagaaggtttccaatcagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacaccattttagaagatgaatgatactgctatttctcttcagggaaacaataatggataaagaaatgtaactgccgggcagcaaagcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagcaatgttgcatgctcacataattgaaaattaaaagtaacacatttttctgaaatgtaaaaaaaagataaa

SEQ ID NO: 459212 - DNA, 2572 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgcaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaaaaaaaaga

SEQ ID NO: 459213 - DNA, 3143 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagttaactgattaaagaggatttgctagggtattctttccacatctgtttgctttctctgggagaataagaagtcataagtcaaagaa

SEQ ID NO: 459214 - DNA, 3160 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgctctgtcaggtcatcaccacttttatgacctttctcggaccccataggctggatcagatgcctcctgaagaattacagacttcttcctctagacttggagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagtta

SEQ ID NO: 459215 - DNA, 2859 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagtta

SEQ ID NO: 459216 - DNA, 2677 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagtta

SEQ ID NO: 459217 - DNA, 2421 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggaaactttttccggagcctgtggggaccttatgctggctgggcccaagcgcaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaaaaaaaaga

SEQ ID NO: 459218 - DNA, 2128 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggcatgactgatgctgccatgatggccactagacatagcctcacggctgtgcccgtgatgtcatatgtgacatttacctacgtgctcctgcgtgctataaataatcctggagtcag

SEQ ID NO: 459219 - DNA, 2390 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgcaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaaaaaaaaga

SEQ ID NO: 459220 - DNA, 3440 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccgggtctcgctctgttgcccaggtaggaatgcagagaggcccattccagcctcgaccccccgggcgcagcctcccgagtagctgggactacaggtgtgcgccatgcccggttaaatttttgtattttttgtagaggtgaggtttcgccatgttgctcagactggaagatagcactgttacttgtattagtttcgtacatggagctattgtaggataggagggaccccaaagggtgcaagaaaggaaattgagtgccagggttgtcatgtgccttgggctcaggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgctctgtcaggtcatcaccacttttatgacctttctcggaccccataggctggatcagatgcctcctgaagaattacagacttcttcctctagacttggagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagtta

SEQ ID NO: 459221 - DNA, 2477 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctggaaactttttccggagcctgtggggaccttatgctggctgggcccaagcggtgagtgtacctaggtgtcctccctaggtttcctctcctccagcccagacccagtggactcttccaccaccgccccaggtggccctaaaggactctccagccacccctgtcccaaccccagtggattctcattgccttcggccctgttccccaaggactcttccacctcccaacactgtcactagtctcaccagccctgaccccagtgtaccctcctccccacacagactccaccctccaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaaaaaaaaga

SEQ ID NO: 459222 - DNA, 2239 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctggaaactttttccggagcctgtggggaccttatgctggctgggcccaagcgcaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaaaaaaaaga

SEQ ID NO: 459223 - DNA, 2810 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggtgagtgtacctaggtgtcctccctaggtttcctctcctccagcccagacccagtggactcttccaccaccgccccaggtggccctaaaggactctccagccacccctgtcccaaccccagtggattctcattgccttcggccctgttccccaaggactcttccacctcccaacactgtcactagtctcaccagccctgaccccagtgtaccctcctccccacacagactccaccctccaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaaaaaaaaga

SEQ ID NO: 459224 - DNA, 3113 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggctggatcagatgcctcctgaagaattacagacttcttcctctagacttggagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagtta

SEQ ID NO: 459225 - DNA, 2865 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgggcctccttggcaatgcatttgatggccaccagcttctgcgtcctcttatcttctgccaggatcacctccgagaaggccccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagtta

SEQ ID NO: 459226 - DNA, 2555 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggtgagtgtacctaggtgtcctccctaggtttcctctcctccagcccagacccagtggactcttccaccaccgccccaggtggccctaaaggactctccagccacccctgtcccaaccccagtggattctcattgccttcggccctgttccccaaggactcttccacctcccaacactgtcactagtctcaccagccctgactcagccttggccttggcattgcccctggtcctgccatatttctggccctgtccctaccctagccttggccctgacccttaccttgctctggccctgcccttgccctaatgcagcccctggccctgtcatgacccttccga

SEQ ID NO: 459227 - DNA, 2878 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagtta

SEQ ID NO: 459228 - DNA, 3681 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtgagtgactgagcctgagaagcctgtcccctcggactggctcctgccgcctcaacactgcctggcatggggtacaaaggaatttgggggatgatggaagaaacccggggtacaaaagaggaaacaagcacgggtagccaacctgttacctttaatatgtctgtacagtgataattgtaaggatccagcggtataaccgatgcagaagataatagcacttgtttttctttttttgagacagggtctcgctctgttgcccaggtaggaatgcagagaggcccattccagcctcgaccccccgggcgcagcctcccgagtagctgggactacaggtgtgcgccatgcccggttaaatttttgtattttttgtagaggtgaggtttcgccatgttgctcagactggaagatagcactgttacttgtattagtttcgtacatggagctattgtaggataggagggaccccaaagggtgcaagaaaggaaattgagtgccagggttgtcatgtgccttgggctcaggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcgctctgtcaggtcatcaccacttttatgacctttctcggaccccataggctggatcagatgcctcctgaagaattacagacttcttcctctagacttggagggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccaggcctggccagtcaaagtagtctctcccctggccacagtaattggtcatgtgatgcaagccagcttactagcactttgagaatgagtctcctgttgagctggtaggatgtaagcctggagctaatggcgatcatctttgccaccacctggggagagcctgcttgggaatgaaattaacacaaaggaagtccaacctgagaaatggccaaatatatttcctgataacattatgtggccctctggatccagccatgcctgaggtctacccctgggcttttggattatgtgtacagttggttcatccctttttctgctaattcgagtcatggctaatttaacaccctttagaaccttaaagaaccatcagcatcacccgggaacttttttagaaatgcaaaatctctactgctttggatcctgggtcaaaaaaaagaaaaaaaaaagaaatgcaaaactttaggccctgccccagatttactaaatcaatctgcagtttaacaaaatcctcaggtgatttgtatgctcattgaactttaagaagcagtgttttagaacaggttcttaaaaaggaacaaataaactcatttaactaaagtta

SEQ ID NO: 459229 - DNA, 2628 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggtgagtgtacctaggtgtcctccctaggtttcctctcctccagcccagacccagtggactcttccaccaccgccccaggtggccctaaaggactctccagccacccctgtcccaaccccagtggattctcattgccttcggccctgttccccaaggactcttccacctcccaacactgtcactagtctcaccagccctgaccccagtgtaccctcctccccacacagactccaccctccaggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatggaaaaaaaaaaga

SEQ ID NO: 459230 - DNA, 2461 bp, Homo sapiens
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttcatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctggtgttccggtgccagcagaaggcctgcttacgtcggcatctgcattccagagccccctaaggtctaggcagcctgaggctgacaggagataaatttttaagaaatcagataagtgaagtgaaagagagagatcaaagtgttgtggcagcacaaaggagagactgactaactttctgctggggaatctgaaagagtgctttggtggaggtaacatgagatcagggccttgaagggtgagtcaagtctgtcaaggagacaagagggagagaagagcttgccagaggcccagagaccagcgaggaggctgtggtgtcctggaatgagggcgagatacttggtgggactggtcaacacggcaatgaagagggatatggccgaggaaaatggagaggggcactggagctgtgccagcaaggactgggatgcgtggacttgatcctgtagataacgggaggaagaaaggcctggatgcagcgccatgtcatgagcacatctgatcatgacagctcacctatgggaggattctccctcaacatttttctgtattttctaaattttctttaatggagcatgttttatttattttcatcattaaaacatagttttatatcttcttttttttttgagaca

SEQ ID NO: 459231 - DNA, 2205 bp, Homo sapiens
accgcacacgtggcgggggtgggagggtgtgagactggcctccacaccacgaaagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgtaaacattttcattcttaaaattatactcatggtaataatttgaaagtatgctgcttccaacataatttctcagagaacaaagactgaccattaatacaaaacaaccttcagaggggtagtctttttatcctttgaaagtatgatacagtatttaattcaaatttccaaatgtatatacatgttcatttttatttttctctagctctgttttataaatacatgtgttcaaaca

SEQ ID NO: 459232 - DNA, 977 bp, Homo sapiens
cttcagtgtaaaacaagaatgatttccagggtttctatccagcaaaagtttaactgtgaggaagctcttttacctattctgtaaggaagtagatttatcagaactcttaatgaattgtggttgtgtttttgagtccaagagtccaacagtactataaatttaaatatggctttttaccagtctggtgagtgtattacattgatttttaagagataaacagtacaaggtagatctttactattgtgttttaaaagcctttgagattttattttctgggatgtgagctatctgaaattttttctcttattaacactcagagggctatatgtatctctcatctctacaagtttattttcaaaatgacacatcccagattgaaatgggcacttagcgaatacttgtggaccacaagacttgtctgagaacatgttcaaagacagttttcaaataaaaatttttcttaatcaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgtaaacattttcattcttaaaattatactcatggtaataatttgaaagtatgctgcttccaacataatttctcagagaacaaagactgaccattaatacaaaacaaccttcagaggggtagtctttttatcctttgaaagtatgatacagtatttaattcaaatttccaaatgtatatacatgttcatttttatttttctctagctctgttttataaatacatgtgttcaaaca

SEQ ID NO: 459233 - DNA, 911 bp, Homo sapiens
accgcacacgtggcgggggtgggagggtgtgagactggcctccacaccacgaaagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcgtaagtacttagttattttgaaataatcaaatatcttgtataggaacaggctggctatgctttttaaaagatatacagtatcatagtctgcagccataactacatttaacagcatgtgttatattgtcataacaagcaaaaaaccacggtctcccctgccttcagaatcagaagaaagcaatccattttacatatagactttcccattagggataagaaattaggatgggtgtgtgtgtgtggatacaaaatactcctccaatggcaagcttttaaaaaataatacttcacctctctttagaagtatagcagctgcacttagtggatactgcctttttattgtttttctcatgccgatttt

SEQ ID NO: 459234 - DNA, 598 bp, Homo sapiens
ctcaaccttacctgaccatagaccctggtttatacagaacctcttactggactcctgatgaaatgtcactttgggaaatgcttattaaggtaccagaacacaagggatggaatatattggcttcatttcaaatttgactcccttttgtgttttttttccagaaccaagatcattatgcagttcttggacttggccatgtgagatacaaggctacacagagacagatcaaagcagctcgtaagtacttagttattttgaaataatcaaatatcttgtataggaacaggctggctatgctttttaaaagatatacagtatcatagtctgcagccataactacatttaacagcatgtgttatattgtcataacaagcaaaaaaccacggtctcccctgccttcagaatcagaagaaagcaatccattttacatatagactttcccattagggataagaaattaggatgggtgtgtgtgtgtggatacaaaatactcctccaatggcaagcttttaaaaaataatacttcacctctctttagaagtatagcagctgcacttagtggatactgcctttttattgtttttctcatgccgatttt

SEQ ID NO: 459235 - DNA, 719 bp, Homo sapiens
cttcagtgtaaaacaagaatgatttccagggtttctatccagcaaaagtttaactgtgaggaagctcttttacctattctgtaaggaagtagatttatcagaactcttaatgaattgtggttgtgtttttgagtccaagagtccaacagtactataaatttaaatatggctttttaccagtctggtgagtgtattacattgatttttaagagataaacagtacaaggtagatctttactattgtgttttaaaagcctttgagattttattttctgggatgtgagctatctgaaattttttctcttattaacactcagagggctatatgtatctctcatctctacaagtttattttcaaaatgacacatcccagattgaaatgggcacttagcgaatacttgtggaccacaagacttgtctgagaacatgttcaaagacagttttcaaataaaaatttttcttaatcaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggttgcagacttaagcgtttatagattgttgtattttaaattgtagcttgggtgatatagctcatattttatgtctattaagtggttaataatatag

SEQ ID NO: 459236 - DNA, 2133 bp, Homo sapiens
accgcacacgtggcgggggtgggagggtgtgagactggcctccacaccacgaaagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgta

SEQ ID NO: 459237 - DNA, 2364 bp, Homo sapiens
accgcacacgtggcgggggtgggagggtgtgagactggcctccacaccacgaaagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgtaaacattttcattcttaaaattatactcatggtaataatttgaaagtatgctgcttccaacataatttctcagagaacaaagactgaccattaatacaaaacaaccttcagaggggtagtctttttatcctttgaaagtatgatacagtatttaattcaaatttccaaatgtatatacatgttcatttttatttttctctagctctgttttataaatacatgtgttcaaaca

SEQ ID NO: 459238 - DNA, 2180 bp, Homo sapiens
accgcacacgtggcgggggtgggagggtgtgagactggcctccacaccacgaaagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaaggatccccaggtgattcttatcagaagctcatcctacagttaattcatcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgta

SEQ ID NO: 459239 - DNA, 2552 bp, Homo sapiens
accgcacacgtggcgggggtgggagggtgtgagactggcctccacaccacgaaagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttggtgagttttgagaagtccatttgttactttaaacacctatttttaaaataacttatgcaatttaatgaaagattaaatgatgatctgttaagtattaaatttttttcatttctcagaccctcatcaaaaagatgacataaataaaaaggcatttgataagttcaaaaaagaacatggagtggtacctcaagcagacaacgcaacgccttcagaacgatttgaaggtaaattttgcttttctaaacgtagaaaatgctagccatgtatctgtgctgcttggacgtacaagacttagggtctatgttcagaatgatagggaaataaaatgtttagcagactggaagctgtaagcaaacatttccagggcaaagatttacttcacctaaccattaaaaatggagaattgcagttgttccatttcagatgccattagagaagggggctgtttgttttgcttaccaggttttacaaaacagtgttagaggatattattgggactaaagaatagtgttatatcgggataattgcttgattttgagaaatgtactgtaattatataagaaaatgtccttatgtttaaggaaaaacacagaagtgttaaggaataaagaggcatcatgtctgtaacttatggttcaaagtatgtctgtacatataggtaaaaataattagcaaatatgaaaatgttcacatttggggaatgtaggcagagtatacagggattctttctactcctctaaaattatttcaaaataaaatgttaaaaattgttagggttcaaaaccaggaaacatagtaagactca

SEQ ID NO: 459240 - DNA, 1577 bp, Homo sapiens
gacttctatgttttaaggagggaaatacttgttttcttgcaggaaaaaataggtaaagttatggtgatgtgatcttaacaatttttttctcagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgta

SEQ ID NO: 459241 - DNA, 1999 bp, Homo sapiens
accgcacacgtggcgggggtgggagggtgtgagactggcctccacaccacgaaagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaaggtatacctatggaactgctattgaagtcttcacttgagcttaggataaagtttcatttcttctttttttttctttagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaaggtactggttttaatgaaacttttcttcaactcacactggagcctggagataatgtagacagactccaaatagcagcacttgttatcacagaaacttgcagagataaattctgtgccacagcagaaaagtatgcacatatacatatgacagaatacttgtttctcaggaaattgaagatcatgagacaagtcttgatttatgttggcttactctgtcatggcttgttctagggattaggttttctgtagtttttcttttacagtcttgctctttgtt

SEQ ID NO: 459242 - DNA, 1552 bp, Homo sapiens
  misc_feature (41)..(41): n is a, c, g, or t
  misc_feature (43)..(43): n is a, c, g, or t
  misc_feature (45)..(47): n is a, c, g, or t
  misc_feature (51)..(51): n is a, c, g, or t
  misc_feature (54)..(54): n is a, c, g, or t
  misc_feature (56)..(56): n is a, c, g, or t
  misc_feature (61)..(61): n is a, c, g, or t
  misc_feature (65)..(65): n is a, c, g, or t
  misc_feature (70)..(70): n is a, c, g, or t
  misc_feature (72)..(72): n is a, c, g, or t
  misc_feature (83)..(84): n is a, c, g, or t
  misc_feature (123)..(123): n is a, c, g, or t
ggtcacagctgattcttgagggtacaacgacgcccagtgantngnnngtcntgngnatggntgcnttcangnacgacaccgannctatgcgaactagaaagttcatgaccaaccgactacttnagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaggacaactggctttggcatgatttatgattccctggattatgcaaagaaaaatgaacccaaacatagacttgcaagacatggcctgtatgagaagaaaaagacctcaagaaagcaacgaaaggaacaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgta

SEQ ID NO: 459243 - DNA, 1125 bp, Homo sapiens
gaaaatcaaggagaaagggaggaggcaggagggagtcgggaaaaaaaatgagagggcggaggaatggatggagggagcgaggctcagggaaaaaagacagatgtaaacaccgggagagatgagaggaacaaggagattcagggacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgta

SEQ ID NO: 459244 - DNA, 763 bp, Homo sapiens
tatacacaaataagtggttttatttatgttgatttgtacaccaaatctgtaagatgtatggacttaaaaccaagattatcgttgatttaaacacatgaaaagcaaaaaccgtagtccaggcaacaggaatttatagtagcagcataattagaccaccaatctgagctcattctgtacatactataacctttctgcagtaaaaatctaatggtttttgtcgtttcattttgtttttccttactactattcatattattgtataatatatcctatcagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgta

SEQ ID NO: 459245 - DNA, 1110 bp, Homo sapiens
tatacacaaataagtggttttatttatgttgatttgtacaccaaatctgtaagatgtatggacttaaaaccaagattatcgttgatttaaacacatgaaaagcaaaaaccgtagtccaggcaacaggaatttatagtagcagcataattagaccaccaatctgagctcattctgtacatactataacctttctgcagtaaaaatctaatggtttttgtcgtttcattttgtttttccttactactattcatattattgtataatatatcctatcagatgggaagttattgctaattacatgaacatacattcttcctctggagtcaaaagaactgccaaagatgttattggcaaagcaaagagtctccaaaaacttggtgagttttgagaagtccatttgttactttaaacacctatttttaaaataacttatgcaatttaatgaaagattaaatgatgatctgttaagtattaaatttttttcatttctcagaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgtaaacattttcattcttaaaattatactcatggtaataatttgaaagtatgctgcttccaacataatttctcagagaacaaagactgaccattaatacaaaacaaccttcagaggggtagtctttttatcctttgaaagtatgatacagtatttaattcaaatttccaaatgtatatacatgttcatttttatttttctctagctctgttttataaatacatgtgttcaaaca

SEQ ID NO: 459246 - DNA, 244 bp, Homo sapiens
aaagcaatggttttaaaacatcacccagacaaacggaaagcagctggtgaaccaataaaagaaggagataatgactacttcacttgcataactaaaggtaagaaaatgctttagagtcaggaatttctaatagtaattgttatttattaattgctgggattgggtttcttatgcatactgtagttcattcaactatcctttgacattttaaaacattttagttatatcaagttctttctaatca

SEQ ID NO: 459247 - DNA, 915 bp, Homo sapiens
accgcacacgtggcgggggtgggagggtgtgagactggcctccacaccacgaaagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtaagtgaatatactgtttgtatgatgctgtcattttttaaaa

SEQ ID NO: 459248 - DNA, 2203 bp, Homo sapiens
accgcacacgtggcgggggtgggagggtgtgagactggcctccacaccacgaaagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttggtaagtagaattgatttaagtcccctaaatgttagaaattcaaaatgagattaactttttcttttgctagacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgta

SEQ ID NO: 459249 - DNA, 2210 bp, Homo sapiens
accgcacacgtggcgggggtgggagggtgtgagactggcctccacaccacgaaagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaaggtatacctatggaactgctattgaagtcttcacttgagcttaggataaagtttcatttcttctttttttttctttagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgta

SEQ ID NO: 459250 - DNA, 2436 bp, Homo sapiens
accgcacacgtggcgggggtgggagggtgtgagactggcctccacaccacgaaagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtaaattttgcttttctaaacgtagaaaatgctagccatgtatctgtgctgcttggacgtacaagacttagggtctatgttcagaatgatagggaaataaaatgtttagcagactggaagctgtaagcaaacatttccagggcaaagatttacttcacctaaccattaaaaatggagaattgcagttgttccatttcagatgccattagagaagggggctgtttgttttgcttaccaggttttacaaaacagtgttagaggatattattgggactaaagaatagtgttatatcgggataattgcttgattttgagaaatgtactgtaattatataagaaaatgtccttatgtttaaggaaaaacacagaagtgttaaggaataaagaggcatcatgtctgtaacttatggttcaaagtatgtctgtacatataggtaaaaataattagcaaatatgaaaatgttcacatttggggaatgtaggcagagtatacagggattctttctactcctctaaaattatttcaaaataaaatgttaaaaattgttagggttcaaaaccaggaaacatagtaagactca

SEQ ID NO: 459251 - DNA, 1922 bp, Homo sapiens
accgcacacgtggcgggggtgggagggtgtgagactggcctccacaccacgaaagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaaggtactggttttaatgaaacttttcttcaactcacactggagcctggagataatgtagacagactccaaatagcagcacttgttatcacagaaacttgcagagataaattctgtgccacagcagaaaagtatgcacatatacatatgacagaatacttgtttctcaggaaattgaagatcatgagacaagtcttgatttatgttggcttactctgtcatggcttgttctagggattaggttttctgtagtttttcttttacagtcttgctctttgtt

SEQ ID NO: 459252 - DNA, 1493 bp, Homo sapiens
acctaacaaagaagagatagcagggcggtgtggttttgattatggagtgatatgtgcattttagattttcataccaaatgcaatgtccttaaaaaaggagaaagacttgaccttagttcaatactagaagggaaggaaaggtatccattaaaacaaattcattcacttgcattaaaaagaattttttttcatttattctgtcttgatcatgtattatttctgtctatattaggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtaaaaattggtcagaagatgatctacaattactaattaaagctgtgaatctgttccctgctggaacaaattcaagatgggaagttattgctaattacatgaacatacattcttcctctggagtcaaaagaactgccaaagatgttattggcaaagcaaagagtctccaaaaacttgaccctcatcaaaaagatgacataaataaaaaggcatttgataagttcaaaaaagaacatggagtggtacctcaagcagacaacgcaacgccttcagaacgatttgaaggtccatatacagacttcaccccttggacaacagaagaacagaagcttttggaacaagctttgaaaacatacccagtaaatacacctgaaagatgggaaaaaatagcagaagcggtgcctggcaggacaaagaaggactgcatgaaacgatacaaggaacttgtcgagatggtaaaagcaaagaaagctgctcaagaacaagtgctgaatgcaagtagagccaagaaatgacaatctttgttgtgtgtgcatttttataataaaactgaaaatactgta

SEQ ID NO: 459253 - DNA, 1945 bp, Homo sapiens
accgcacacgtggcgggggtgggagggtgtgagactggcctccacaccacgaaagatccatcccggaagtgcttactcgtcgtctccatgcgccggttcctgggcgtcttagagccaaggcgcgaggctcggagtgagaggtagagctggaggggaccctaagcgccctccgcccgggacgtgagccgctgcgcccaccgggctagacccggcgccatcatgctgcttctgccaagcgccgcggacggccggggcaccgccatcacccacgctctgacctctgcctctacactctgtcaagttgaacctgtgggaagatggtttgaagcttttgttaagaggagaaacagaaatgcttctgcctcttttcaggaactggaggataagaaagagttatccgaggaatcagaagatgaagaattgcagttggaagagtttcccatgctgaaaacacttgatcccaaagactggaagaaccaagatcattatgcagttcttggacttggccatgtgagatacaaggctacacagagacagatcaaagcagctcataaagcaatggttttaaaacatcacccagacaaacggaaagcagctggtgaaccaataaaagaaggagataatgactacttcacttgcataactaaagcttatgaaatgttatctgatccagtgaaaagacgagcatttaacagtgtagatcctacttttgataactcagttccttctaaaagtgaagcaaaggataatttcttcgaagtgtttaccccagtgtttgaaaggaattccagatggtcaaataaaaaaaatgttcctaaacttggtgatatgaattcatcatttgaagatgtagatatattttattctttctggtataattttgattcttggagagaattttcttatttagatgaagaagaaaaagaaaaagcagaatgtcgtgatgagaggagatggattgaaaagcagaacagagcaacaagagcacaaagaaaaaaagaagaaatgaacagaataagaacattagttgacaatgcatacagctgtgatccaaggataaaaaagttcaaggaagaagaaaaagccaagaaagaagcagaaaagaaagcaaaagcagaagctaaacggaaggagcaagaagctaaagaaaaacaaagacaagctgaattagaagctgctcggttagctaaggagaaagaagaggaggaagtcagacagcaagcattgctggcaaagaaggaaaaagatatccagaaaaaagccattaagaaggaaaggcaaaaacttcgaaactcatgcaagacctggaatcatttttctgataatgaggcagagcgggttaaaatgatggaagaagtggaaaaactttgtgatcggcttgaactggcaaggtatacctatggaactgctattgaagtcttcacttgagcttaggataaagtttcatttcttctttttttttctttagcttacagtgcttgaatgaaacactcacatcatgcacaaaagaagtaggaaaggctgctttggaaaaacagatagaagaaataaatgagcaaatcagaaaagagaaagaggaagctgaggctcgtatgcgacaagcatctaagaacacagagaaatcaactggtggaggtggaaatggaagtactgctggaacaaattcaaggtactggttttaatgaaacttttcttcaactcacactggagcctggagataatgtagacagactccaaatagcagcacttgttatcacagaaacttgcagagataaattctgtgccacagcagaaaagtatgcacatatacatatgacagaatacttgtttctcaggaaattgaagatcatgagacaagtcttgatttatgttggcttactctgtcatggcttgttctagggattaggttttctgtagtttttcttttacagtcttgctctttgtt

SEQ ID NO: 459254 - DNA, 260 bp, Homo sapiens
agtctggtgagtagctgggactacaggcatgagccacactgttggcctcttcttgtacctctgaggtttcatttcttacatatgatttctttttgatactgctgagatttattctggtataaattgtgaggtgagatttcaccccatgttttaaaaaacaattttaggatttcttgatcttttatgtcttgtctggagagtaatttgtcagctgttttctgctaaactgtgagtggtgtaagaccagttagctatgccct

SEQ ID NO: 459255 - DNA, 1474 bp, Homo sapiens
gcagcctcacggcaagactactttgttctggggctcccccgacctcggcctgggccctgctgtctctacctgtggggcctacacatgtggacagctacagccagggggtgccacggtcacaccacccaacaaagcaagaaccccccagcagagaatgccctttcaaaggtgccactgaactctatccttggagacaacccctggctccgagggactgggtgtgcggtccagaactgcggtgccctgggctcaaccctggctgaaggcgctgaacacctcccacgaggcacctgcacctttgggtcagcaaagctccaaagaacctgttctcaggtgctgagaaaccactgtctcccccaagggcaaggccagccctgcccgcccttctcttggacggtattgaggccacagtattgcacccagcagggttccaattctctaggaatggaacgcagtgatctggataggaattaaatagatgaagtggagggtttgctcccacactggcttccacatcaacagcaccagttttgaccacgtggagctgctggcggagggcgcgcatggtggctgttgcccgtccggtgttttgctggattaatgtagactgctttgtttgcagggctcattgtcatccccaagccaggccagttctccaggtggaactgtagtgtagcgacctcactgctgcgcgcacagtctcccgggacttggactcgagggagtgacgaggaggagctccgagctgcgcctgagccgtgccagccggcggacctcaggcggtggacgtcggcgatactgtgtggacggtgaccggctcactctgcggcgccgtgctcccgctgctcacccaaagaagttgtttccattttaaaccggtcttttggggctgcagtaaaaaataagaaatggagttttcttgctttttactctaaaattcaatgtaattaaatttcatatatatataatatatacatatatacatagtgtaaaataaaatgtttcttggacaagaaatcccctgaaattcagctgttatagtgcttcactgtttttgcactgatttttctataccttaggtggtcagaagacaaccttgaatgcactcatagagaaaactgttactttctgacgtaatgtaattcaggaagacagacgctgcaatcacagattttaaaaaattgtttgcacttaaaaatagttgaatgctggtggaaagttactttgcagatgggtgtaaggactcatggccctctgaggtgcggcgtgaagatgccctttttacccgttgacgtttattttacgtaaaataaactgttgtttccaatgcaatcaactctgtattatatgtataaatattgtaattctgcaattggggaaaatagttacttcactagtaattttcatcatttaagagtgatatttctaattcacaaaagttaatattaaaactatcttgaatataaaaaaaatt

SEQ ID NO: 459256 - DNA, 2431 bp, Homo sapiens
agcgggcgcggtgggcgtgatccgggcacttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttcaaagaagcagtttgtagcactt

SEQ ID NO: 459257 - DNA, 1157 bp, Homo sapiens
agcgggcgcggtgggcgtgatccgggcacttagggcaggatgaacgctgctttccaagatggcgacggagggaggagggaaggagatgaacgagattaagacccaattcaccacccgggaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaggctcattgtcatccccaagccaggccagttctccaggtggaactgtagtgtagcgacctcactgctgcgcgcacagtctcccgggacttggactcgagggagtgacgaggaggagctccgagctgcgcctgagccgtgccagccggcggacctcaggcggtggacgtcggcgatactgtgtggacggtgaccggctcactctgcggcgccgtgctcccgctgctcacccaaagaagttgtttccattttaaaccggtcttttggggctgcagtaaaaaataagaaatggagttttcttgctttttactctaaaattcaatgtaattaaatttcatatatatataatatatacatatatacatagtgtaaaataaaatgtttcttggacaagaaatcccctgaaattcagctgttatagtgcttcactgtttttgcactgatttttctataccttaggtggtcagaagacaaccttgaatgcactcatagagaaaactgttactttctgacgtaatgtaattcaggaagacagacgctgcaatcacagattttaaaaaattgtttgcacttaaaaatagttgaatgctggtggaaagttactttgcagatgggtgtaaggactcatggccctctgaggtgcggcgtgaagatgccctttttacccgttgacgtttattttacgtaaaataaactgttgtttccaatgcaatcaactctgtattatatgtataaatattgtaattctgcaattggggaaaatagttacttcactagtaattttcatcatttaagagtgatatttctaattcacaaaagttaatattaaaactatcttgaatataaaaaaaatt

SEQ ID NO: 459258 - DNA, 2248 bp, Homo sapiens
agcgggcgcggtgggcgtgatccgggcacttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttcaaagaagcagtttgtagcactt

SEQ ID NO: 459259 - DNA, 2172 bp, Homo sapiens
agcgggcgcggtgggcgtgatccgggcacttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttcaaagaagcagtttgtagcactt

SEQ ID NO: 459260 - DNA, 2246 bp, Homo sapiens
agcgggcgcggtgggcgtgatccgggcacttagggcaggatgaacgctgctttccaagatggcgacggagggaggagggaaggagatgaacgagattaagacccaattcaccacccgggaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttcaaagaagcagtttgtagcactt

SEQ ID NO: 459261 - DNA, 2170 bp, Homo sapiens
aggggatctctgagggatgtagtaacttgccaaggctacacagctggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttcaaagaagcagtttgtagcactt

SEQ ID NO: 459262 - DNA, 729 bp, Homo sapiens
agcgggcgcggtgggcgtgatccgggcacttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaagcttttgaggggaggtatgctacattttcaccatttgtatgaatgcagccacggaaaacttcacatcagctcagccctcggtttagttttcttcggaggagacattagttacagcttgagttctcagcctgccccactcgaaggcgccagcagggactctggatcacggggccatgaactatggagtgagtcttctagaaagagaaataataaaagacactaagacttgctgttctaaa

SEQ ID NO: 459263 - DNA, 597 bp, Homo sapiens
cacatgcattgtcccttatgatctcacagatactttgcagaagagggagtggcgcgtcccactttatattatatagagatgagagaggggatctctgagggatgtagtaacttgccaaggctacacagctggtaagtggcagccggagatttcagcaaggcctgtcagactccaaagcctatgttctttctagcaccccaccccgcttttcatgtaaactcttgctcccagagaatgcgtgtgcctgtgtggctgtcatgtggttttataataaatggttgtaatacctgtatttctagatttctctcctcatatacttaacccacccaataagcagcaacctttcagctttttaaaaaaagactattttctatttaataatattcatttatttacaatgtgtcagaattaggaggtattataaaagcggcctttgagatcatattctaacctctgtattttcacaggtagagccatcatatgtgctactctatttttgtctcagaaattaaactttcattgaggtgtaaattggtatactacacagttctgacctctgaacttctaacttttttttaaagtatttttttttttcta

SEQ ID NO: 459264 - DNA, 2524 bp, Homo sapiens
agcgggcgcggtgggcgtgatccgggcacttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaaactcttgtcagcacttgtggaaggtggattggaatgaagaaagacagaatgaaggtagcaagaccagtgaggaggctctagtaactgtccagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttcaaagaagcagtttgtagcactt

SEQ ID NO: 459265 - DNA, 2254 bp, Homo sapiens
agtctggtgagtagctgggactacaggcatgagccacactgttggcctcttcttgtacctctgaggtttcatttcttacatatgatttctttttgatactgctgagatttattctggtataaattgtgaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttcaaagaagcagtttgtagcactt

SEQ ID NO: 459266 - DNA, 2063 bp, Homo sapiens
agcgggcgcggtgggcgtgatccgggcacttagggcaggatgaacgctgctttccaagatggcgacggagggaggagggaaggagatgaacgagattaagacccaattcaccacccgggaagagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactggaatattttttgcttaactactcaattagaatattgtacacctgatcaatgtgtgttcagcacagatggccatgaattgtcatttatagtccaattttttatcttaatcataaaatgtttaggaatctatgaaatttaactttaggaacaaaacgtttagcagggttgattgatattatttttacattgttctggcaatccacagaaagagaagagccttaatttttaaaacccattttagtcattttatgacaattaaagttgtttaataaacatcttttttcaaagaagcagtttgtagcactt

SEQ ID NO: 459267 - DNA, 2126 bp, Homo sapiens
agcgggcgcggtgggcgtgatccgggcacttagggcaggatgaacgctgctttccaagatggcgacggagggaggagggaaggagatgaacgagattaagacccaattcaccacccgggaaggtctgtacaagctgctgccgcactcggagtacagccggcccaaccgggtgcccttcaactcgcagggatccaaccctgtccgcgtctccttcgtaaacctcaacgaccagtctggcaacggcgaccgcctctgcttcaatgtgggccgggagctgtacttctatatctacaagggggtccgcaaggctgctgacttgagtaaaccaatagataaaaggatatacaaaggaacacagcctacttgtcatgacttcaaccacctaacagccacagcagaaagtgtctctctcctagtgggcttttccgcaggccaagtccagcttatagacccaatcaaaaaagaaactagcaaactttttaatgaggaaagactaatagacaagtcacgagttacctgtgtcaaatgggttcccggttcggaaagccttttcctagtagcccactcgagtgggaacatgtacttatataatgtggagcacacttgtggcaccacagccccccactaccagcttctgaagcagggagagagctttgccgtgcacacttgcaagagcaaatccacgaggaaccctctccttaagtggacggtgggcgagggggccctcaacgagtttgctttctccccagatggcaagttcttagcgtgcgtgagccaggacgggtttctgcgggtgttcaactttgactcagtggagctgcacggtacgatgaaaagctactttgggggcttgctgtgtgtgtgctggagcccggatggcaagtacatcgtgacaggtggggaggacgacttggtgacagtctggtcctttgtagactgccgagtaatagccagaggccacgggcacaagtcctgggtcagtgttgtagcgtttgacccttataccactagtgtagaagaaggtgaccctatggagtttagtggcagcgatgaggacttccaagaccttcttcattttggcagagatcgagcaaatagtacacagtccaggctctccaaacggaactctacagacagccgccccgtaagtgtcacgtatcggtttggttccgtgggccaggacacacagctctgtttatgggaccttacagaagatatccttttccctcaccaacccctctcaagagcaaggacacacacaaatgtcatgaatgccacgagtcctcctgctggaagcaatgggaacagtgttacaacacccgggaactctgtgccgcctcctctgccacggtccaacagccttccacattcagcagtctcaaatgctggcagcaaaagcagtgtcatggacggggccattgcttctggggtcagcaaatttgcaacactttcactacatgaccggaaggagaggcaccacgagaaagatcacaagcgaaatcatagcatgggacacatttctagcaagagcagtgacaaactgaatctagttaccaaaaccaaaacggaccctgctaaaactctgggaacgcccctgtgtcctcgaatggaagatgttcccttgttagagccgctgatatgtaaaaagatagcacatgagagactgactgtactaatatttcttgaagactgtatagtcactgcttgtcaggagggatttatttgcacatggggaaggcctggtaaagtggtaagttttaatccttaatgctgcaccagatctagaacttgaataggtagtgacttttttctttttcgtgggaggggtggggtgtacaatgaatgtgaatgacacttcttattcttaatgtaaatctcaatgcatcagagccataattttggatactgcatgccatgtaattctgaatcatttgataatttaccttagagcatttaaaaaaatataatcaaactaattgccagccaagtcagtcatcctcctgggagtatatagagtcccaaggttagcgctcctgtattagactatttcaattttaggaaaatcatgaccatgtggggaaacaatgactttaaaatgctgaaattaaaatttatgctttaactgg

SEQ ID NO: 459268 - DNA, 575 bp, Homo sapiens
gctagtcactttggctattaactcttaggaaattcaaagaaagacatttgaaaataggaacctattattattacaagtaagaatccttatgcaacattcacattaataggctactgatacatggcttgagggagaggaaatcactgcatacccaggtgtgccctccatgtcagcctaaaggactggtttgggtgctttgagtccccagacccaggagtctttgattttaaacttcctttccttctggtgcggcagcaaaggtgccatctagaaagcccagagtttctgagtacacatgggatacccaggaagtccagtgtgcaatgtatcaggtgccaggggaggtaagcaggtgtgttctatggaacagcaccaggtcacctgtccctgtagcatacagagggaattaccacccccgcaactgccccacctaacgtggccatctgttcaccaccagccagtgctaccagccatttcagcttagaataacatctcaggtgtttctcagctgtacctgagctggaagctgctttctcctgcctcagacttttgttcctttactttccatgttccac

SEQ ID NO: 459269 - DNA, 1113 bp, Homo sapiens
cacttagcaaagacagcagatcctggtgccagggcacagggctcacctggatgtggggaggagtggctctggcacctgccaatactttgggtcctacaggccctgcttgaggtctttggcctctttggtctttggtctttttctcctggaacagaagttgaaatggggaggagacctgggcagtgctcttggaaattaacccttcacttctctgcccctgtgtttcagttcaaatcagccttctcatctgcggaaaccacagaattgagtggcaaatgtgtggtggctttggcaacaggtgaagtttgggggcagctggtaataagaaagggcatggaggatgtgtagtgcggtagcatccagtgcccagatctggctcgggagttggttgaggaacatgtcattcttttctctgctttttgaggcccaaggggtcagcattcccagtttgaggtctgagagccttaggagcaggctcctgggaagtgtggaaaaagtccaaggcccaagagaaagagctctccagggatcctgagctccagggctctcagcagtgccctgtccaactgggcccaaaccttgtcactctgcatactcccctgcctgccatctccacctgtctgtgtgcccgcagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttcaa

SEQ ID NO: 459270 - DNA, 386 bp, Homo sapiens
atcaccctccctgtgccttccagacgatcctgaacaccaggaataaggcattctgggaaacccctgcctccatgtgggatgatatcaacaacgtcggactcagcctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttcaa

SEQ ID NO: 459271 - DNA, 129 bp, Homo sapiens
aaggacaaggaaaaccaaggcacaaagaagggacctaggcgccttggttttccttgtccttctttttactttttgccttagtattgaaaaatgctcttggagctaataaaagtctcatttctctttcaa

SEQ ID NO: 459272 - DNA, 1763 bp, Homo sapiens
cagatcgctccgcccccatccgcaggttctaacttgggctgggactctgcccctctacctcagcacagaatcgccccgggtcctactacagaatcaatccttgaacactgcctccacgtcgccggctcaatctgggcgagaacccagacttccaccgcagccccgcaatctgcagacctcagcggcagcgcaggtggcagacctgcctcctttgcctgtgagtcatggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggcacaatccctcgggggccaatgtgtgcctgtggtgtgcgattcaagccaggagagtgaagtgcgaagcctgtttgagcaagtggatcgggaacagcaagggcgtctagatgtgctggtcaacaatgcttatgcaggggtccagacgatcctgaacaccaggaataaggcattctgggaaacccctgcctccatgtgggatgatatcaacaacgtcggactcagaggccactacttttgctcagtgtatggggcacggctgatggtaccagctggccaggggctcatcgtggtcatctcctccccaggaagcctgcagtatatgttcaatgtcccctatggtgtgggcaaagctgcgtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcagttcaaatcagccttctcatctgcggaaaccacagaattgagtggcaaatgtgtggtggctttggcaacaggtgaagtttgggggcagctggtaataagaaagggcatggaggatgtgtagtgcggtagcatccagtgcccagatctggctcgggagttggttgaggaacatgtcattcttttctctgctttttgaggcccaaggggtcagcattcccagtttgaggtctgagagccttaggagcaggctcctgggaagtgtggaaaaagtccaaggcccaagagaaagagctctccagggatcctgagctccagggctctcagcagtgccctgtccaactgggcccaaaccttgtcactctgcatactcccctgcctgccatctccacctgtctgtgtgcccgcagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttcaa

SEQ ID NO: 459273 - DNA, 976 bp, Homo sapiens
cagatcgctccgcccccatccgcaggttctaacttgggctgggactctgcccctctacctcagcacagaatcgccccgggtcctactacagaatcaatccttgaacactgcctccatgtgggatgatatcaacaacgtcggactcagaggccactacttttgctcagtgtatggggcacggctgatggtaccagctggccaggggctcatcgtggtcatctcctccccaggaagcctgcagtatatgttcaatgtcccctatggtgtgggcaaagctgcgtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcagttcaaatcagccttctcatctgcggaaaccacagaattgagtggcaaatgtgtggtggctttggcaacagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttcaa

SEQ ID NO: 459274 - DNA, 1373 bp, Homo sapiens
cagatcgctccgcccccatccgcaggttctaacttgggctgggactctgcccctctacctcagcacagaatcgccccgggtcctactacagaatcaatccttgaacactgcctccacgtcgccggctcaatctgggcgagaacccagacttccaccgcagccccgcaatctgcagacctcagcggcagcgcaggtggcagacctgcctcctttgcctgtgagtcatggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggcacaatccctcgggggccaatgtgtgcctgtggtgtgcgattcaagccaggagagtgaagtgcgaagcctgtttgagcaagtggatcgggaacagcaagggcgtctagatgtgctggtcaacaatgcttatgcaggggtccagacgatcctgaacaccaggaataaggcattctgggaaacccctgcctccatgtgggatgatatcaacaacgtcggactcagaggccactacttttgctcagtgtatggggcacggctgatggtaccagctggccaggggctcatcgtggtcatctcctccccaggaagcctgcagtatatgttcaatgtcccctatggtgtgggcaaagctgcgtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcagttcaaatcagccttctcatctgcggaaaccacagaattgagtggcaaatgtgtggtggctttggcaacagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgccttgtccttctttttactttttgccttagtattgaaaaatgctcttggagctaataaaagtctcatttctctttcaa

SEQ ID NO: 459275 - DNA, 1427 bp, Homo sapiens
cagatcgctccgcccccatccgcaggttctaacttgggctgggactctgcccctctacctcagcacagaatcgccccgggtcctactacagaatcaatccttgaacactgcctccacgtcgccggctcaatctgggcgagaacccagacttccaccgcagccccgcaatctgcagacctcagcggcagcgcaggtggcagacctgcctcctttgcctgtgagtcatggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggcacaatccctcgggggccaatgtgtgcctgtggtgtgcgattcaagccaggagagtgaagtgcgaagcctgtttgagcaagtggatcgggaacagcaagggcgtctagatgtgctggtcaacaatgcttatgcaggggtccagacgatcctgaacaccaggaataaggcattctgggaaacccctgcctccatgtgggatgatatcaacaacgtcggactcagaggccactacttttgctcagtgtatggggcacggctgatggtaccagctggccaggggctcatcgtggtcatctcctccccaggaagcctgcagtatatgttcaatgtcccctatggtgtgggcaaagctgcgtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcagttcaaatcagccttctcatctgcggaaaccacagaattgagtggcaaatgtgtggtggctttggcaacagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttcaa

SEQ ID NO: 459276 - DNA, 992 bp, Homo sapiens
cagatcgctccgcccccatccgcaggttctaacttgggctgggactctgcccctctacctcagcacagaatcgccccgggtcctactacagaatcaatccttgaacactgcctccacgtcgccggctcaatctgggcgagaacccagacttccaccgcagccccgcaatctgcagacctcagcggcagcgcaggtggcagacctgcctcctttgcctgtgagtcatggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggcacaatccctcgggggccaatgtgtgcctgtggtgtgcgattcaagccaggagagtgaagtgcgaagcctgtttgagcaagtggatcgggaacagcaagggcgtctagatgtgctggtcaacaatgcttatgcaggggtccagacgatcctgaacaccaggaataaggcattctgggaaacccctgcctccatgtgggatgatatcaacaacgtcggactcagaggccactacttttgctcagtgtatggggcacggctgatggtaccagctggccaggggctcatcgtggtcatctcctccccaggaagcctgcagtatatgttcaatgtcccctatggtgtgggcaaagctgcggtgaggacccagtggcataggagctgaggaggtcaaagacagtgatgttacctatagctcaggaggtacaatccccagtggtcagaatggtaagggctggctcctctcagcgtcctcctctgcctcatccatggacagttcctttgcttgttgctcctcttgggtggctagaagtaggcattcacactggggagcgttggcagctgagaccttggggctcctgggaaggacaggtggttggagcattcacagtagaagcag

SEQ ID NO: 459277 - DNA, 1488 bp, Homo sapiens
cagatcgctccgcccccatccgcaggttctaacttgggctgggactctgcccctctacctcagcacagaatcgccccgggtcctactacagaatcaatccttgaacactgcctccacgtcgccggctcaatctgggcgagaacccagacttccaccgcagccccgcaatctgcagacctcagcggcagcgcaggtggcagacctgcctcctttgcctgtgagtcatggcagctcccatgaatggccaagtgtgtgtggtgactggtgcctccaggggtattggccgtggcattgccttgcagctctgcaaagcaggcgccacagtttacatcactggccgccatctggacacccttcgcgttgttgctcaggaggcacaatccctcgggggccaatgtgtgcctgtggtgtgcgattcaagccaggagagtgaagtgcgaagcctgtttgagcaagtggatcgggaacagcaagggcgtctagatgtgctggtcaacaatgcttatgcaggggtccagacgatcctgaacaccaggaataaggcattctgggaaacccctgcctccatgtgggatgatatcaacaacgtcggactcagaggccactacttttgctcagtgtatggggcacggctgatggtaccagctggccaggggctcatcgtggtcatctcctccccaggaagcctgcagtatatgttcaatgtcccctatggtgtgggcaaagctgcgtgtgacaagctggctgctgactgtgcccacgagctgcggcgccatggggtcagctgtgtgtctctgtggccggggattgtgcagacagaactgctgaaggagcatatggcaaaggaggaggtcctgcaggatcctgtgttgaagcagttcaaatcagccttctcatctgcggaaaccacagaattgagtggcaaatgtgtggtggctttggcaacagatcccaatatcctgagcctgagtggtaaggtgctgccatcctgtgaccttgctcgacgctatggccttcgggatgtggacggccgccccgtccaagactatttgtctttgagctctgttctctcacacgtgtccggcctgggctggctggcctcctacctgccctccttcctccgtgtgcccaagtggattattgccctctacactagcaagttctaaccctcctggtctgacactacgtctctgcttgtcttctcatttggacttggtggttcgtcctgtctcagtgaaacagcagcctttcttgtttacccatacccttgatatgaagagaagccctctgctgtgtgtccgtggtgagttctggggtgcgcctaggtcccttctttgtgccttggttttccttgtccttctttttactttttgccttagtattgaaaaatgctcttggagctaataaaagtctcatttctctttcaacatctcctactctcccatcatccttctacctccttccctccctccccttcttctctttcct

SEQ ID NO: 459278 - DNA, 2408 bp, Homo sapiens
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacggtgacggccgcccgcaggcgtgggaccccctgtgaggctgaggcccgagcaggtactgaccccttgtccttccccacagccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccggcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggacagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaaactgaaataaattctaattttggaaactcc

SEQ ID NO: 459279 - DNA, 2162 bp, Homo sapiens
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccggcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggacagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaaactgaaataaattctaattttggaaactcc

SEQ ID NO: 459280 - DNA, 2091 bp, Homo sapiens
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccggcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggacagaattcgtgttcttgggtctgtcccgagtgggctcgcgtgcagccaaacaacccaggccatctctggttgtgtctgtgccgactcggtgttgaatcaaatcaggtgtgcgtcaggagccggctgtgtccttcctgccacactcggggattcattccttagaaactgaaataaattctaattttggaaactcc

SEQ ID NO: 459281 - DNA, 2563 bp, Homo sapiens
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcaggtagggctgcccccgggaccctggccggcctgcagggtggtctgtgggaggctccaggccctcctgtgcaggtccaagcgcagccaatcctcactcaaggccttccctgccctttccttccgccacaaatcccaaacaaacgtgctgtggtccctgcccggtgtccacagtgccagccccacccccccagcccgttgcccatccctgcggggctgcagccatccctctccacagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccggcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggacagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaaactgaaataaattctaattttggaaactcc

SEQ ID NO: 459282 - DNA, 2642 bp, Homo sapiens
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcaggtagggctgcccccgggaccctggccggcctgcagggtggtctgtgggaggctccaggccctcctgtgcaggtccaagcgcagccaatcctcactcaaggccttccctgccctttccttccgccacaaatcccaaacaaacgtgctgtggtccctgcccggtgtccacagtgccagccccacccccccagcccgttgcccatccctgcggggctgcagccatccctctccacagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacggtgacggccgcccgcaggcgtgggaccccctgtgaggctgaggcccgagcaggtactgaccccttgtccttccccacagccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccggcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggacagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaaactgaaataaattctaattttggaaactcc

SEQ ID NO: 459283 - DNA, 1751 bp, Homo sapiens
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaaccttggtctggacaaacacccaaccacagacaaacaaacacctgaagcgaaccatcaaactgtcacagggaatgcggcaacaaacgacggcacgtccgaaccggggccacaagcgggcacaatgcacgcgtgcaacccagcgaaacccccggcgcctccagtcagcgcacaacaaacaggcggggagaaagaaccccgcccccggggtcacacccactcaataagagcggacggccggatgctcaaaagacgccaacgaaaagacccgcagggctcaacacgccgggacacataagaggcgaagctagcggacccaat

SEQ ID NO: 459284 - DNA, 4305 bp, Homo sapiens
  misc_feature (1557)..(1557): n is a, c, g, or t
  misc_feature (2861)..(2861): n is a, c, g, or t
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagggtgcgcagccgcgggcaagggtcagggtcagggtcggggtcaaagccacctgtttgcctgttgcccaggttcctctcacagcccatgcccccagtcagtgtggctgtgcctggcctgccctggggattgccgggttagggacctcccctgggccaggagaaatgaaagaggctccattacccggtttcaggcaagggaggaggaaatgggtggctctccaagctgaggcaggggctggtcacccgaggactgggttgctgagcagttgctggggatgggtcaggtctcagtgcaaggttggccccccggtaccacacccaggcccaaagtgggtggggctcagggctcctcctgtccccacttctccagccttgcagtgaccggagaggcaggactttctcattgctctttgtgttttcggtttttgttttttttttttgagacagagtctcgctctgttgcccaggctggagtgcagtggtgcgatcttggctcactgcaaccttcgcctcctgggttctagtgatgctcccgcctcagcctcctgagtagctgggattacaggtgcctgccaccacacctggctaattttttgtatttttagtagagacggggtttcaccatgttgcccaggttcatctcaaactcctgagctcaggcaatccacccacctcagcctcccaaagtgctgggaatacaggcatgagccaccgcgcccggccaggctttgtgttttcaaaggaaacaattataatgagatcttatagaaatgtccctaaacgtttggcgcctgcctttcattttttaatttctccagatgaggcaagtcaccaaagaagacctctgtgggccgtcttctaaagggcagtccccggtccagccagggcccagcactgggcagcctccccaccagagcctggggcccagtgatctcgaaggggcatagaattcggcagtgccgtgctgctcactgctgcggtgtcacagagggaagggggcgtggggcagggtctggganacaccaggtgtccgcttcacctgtcccctcccgggggacactcgctgtgccctggtgtctaggtttctactggggttggtcacaggcacgtctgagctcagaccccagcccctccagaggtggagtgggtcccagtggaccaaggcctcgtgaatgtctcatcctaagttagcctgggctccccagggtggcctgggccccggggaaacacgggcactccatcaggcgggacattcccagggctcatggctcaggcccagaccgtccctgggcgcgtgcaggtgtgagcgattgcccggcgctgtgtggcccccggggctttgctgcccttctgtgggcatcatctccttcacacgtggacacccccgtggtgccagccggccggtgagacaggggcaataggcctcgggctgtagctgctgaagatgggggtggcctggtgtccgcaccagcagtgctgtgctgacctcagcaggcaggtgtgagtggtgaggccctttctccagcctgcctgcccagcacccagcgtctgtgccagctcaaggcggccccttcgcagaacgagactgcctcatgaaggccttttcttcttctttttttttttttgagacagagcagtctcactctgtcacccaggctggtgatctcggctcactgcaacctctgcctccggggttcaagtgattctcctgcctcagcctcccgagtagctgggattacaggcacccgccagcacacccggctaatttttatatttttagtagagatggggtttcgccatgttggccaggctggtctgagagagaactcctgacctcgtgatccgcctgcctcagcctcccaaagtgctgggatgacaggcgtgcgccactgcacccggcccgtgaaggtcttttctgaagggagctacctttgagaagtgcctgttgggacagaactccctgctctggtctgaccctctgcacgctagggtggtcctgcacctgtcggggagggggccaaggacacagcactgggctggggcagggctctgcgctggtgctgcctgccatcccagttctgccattcccccagcgcacccccgcacccgcccctccagctgatgcctgctccctctctctgcagaacgggctcatgtcggggctgatgcagatgctgctgctgaaggtgtctgcacacatcaccgagcagctgggcatggccccaggtggcgagttcagggaggccttcaaggaggtgggcacagggtgaggtagggggtggccacagggatgtggctcacaggggtggtccggggttcccantgctccccaacacccagcctctgctccaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcaggtagggctgcccccgggaccctggccggcctgcagggtggtctgtgggaggctccaggccctcctgtgcaggtccaagcgcagccaatcctcactcaaggccttccctgccctttccttccgccacaaatcccaaacaaacgtgctgtggtccctgcccggtgtccacagtgccagccccacccccccagcccgttgcccatccctgcggggctgcagccatccctctccacagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacggtgacggccgcccgcaggcgtgggaccccctgtgaggctgaggcccgagcaggtactgaccccttgtccttccccacagccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaaccttggtctggacaaacacccaaccacagacaaacaaacacctgaagcgaaccatcaaactgtcacagggaatgcggcaacaaacgacggcacgtccgaaccggggccacaagcgggcacaatgcacgcgtgcaacccagcgaaacccccggcgcctccagtcagcgcacaacaaacaggcggggagaaagaaccccgcccccggggtcacacccactcaataagagcggacggccggatgctcaaaagacgccaacgaaaagacccgcagggctcaacacgccgggacacataagaggcgaagctagcggacccaat

SEQ ID NO: 459285 - DNA, 2107 bp, Homo sapiens
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaaagagaaaaactgaagtaaatgtcaaaaaacaccagccttaaatccaaagggacagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaaactgaaataaattctaattttggaaactcccaaacaaccaaaacacaacaaacacaaaaaacataacaaatctacaaaaaaacaactcgaacccacaacaccggcgcgggcggcgacaccttaaaagaatagacccccctacggggggggcacaacattatacgcagtttcgaactcagggtgagcttgaactaaaacaagatcgggcggccacaactatttaggaggacgttaactaaaaataaaccagatagggtagggtgctacgtatctttaaacgacgagccgttctaagacaagcgctacaacaggctcaaccaaggaaggaaacactcatagtggaaaggaaagagccccaactctaagatggtggggggaagtcaaaaacggaggccgaacatgatcccg

SEQ ID NO: 459286 - DNA, 965 bp, Homo sapiens
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacacccaggccatctctggttgtgtctgtgccgactcggtgttgaatcaaatcaggtgtgcgtcaggagccggctgtgtccttcctgccacactcggggattcattccttagaaactgaaataaattctaattttggaaactcc

SEQ ID NO: 459287 - DNA, 2329 bp, Homo sapiens
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccggcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggacagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaaactgaaataaattctaattttggaaactcc

SEQ ID NO: 459288 - DNA, 2302 bp, Homo sapiens
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgacagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccggcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggacagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaaactgaaataaattctaattttggaaactcc

SEQ ID NO: 459289 - DNA, 2225 bp, Homo sapiens
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgacgtgagtgcccgcccctccctgcaagccccaccccacaagcccccaggtggaggctgagcgccctggaggccaaccacatgcggcagtgacccaggcatgggggctggggtatggggagcccacccccagccaggcccagcgccccctccctcccacagcgtgcccccgccgtccgtctccggcagagtgtctcggttggccgtgaaggccgccttcttcggcctgctgggctacagcctgtactggattatttaactgtctgagctcaggcctcccggcagcccctcccctcccacactgcaggggccgttccccggcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggacagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaaactgaaataaattctaattttggaaactcc

SEQ ID NO: 459290 - DNA, 1771 bp, Homo sapiens
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccggcttctggacaagacacccagctccgagggggcaggggcttataggaggggccgaggcgtgcgctgccctctcagccctggtggcaggcgggggacaatggccactgtccctacctcactgtgccttcctgtgctacccaggccatctctggttgtgtctgtgccgactcggtgttgaatcaaatcaggtgtgcgtcaggagccggctgtgtccttcctgccacactcggggattcattccttagaaactgaaataaattctaattttggaaactcc

SEQ ID NO: 459291 - DNA, 4570 bp, Homo sapiens
  misc_feature (1557)..(1557): n is a, c, g, or t
  misc_feature (2861)..(2861): n is a, c, g, or t
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagggtgcgcagccgcgggcaagggtcagggtcagggtcggggtcaaagccacctgtttgcctgttgcccaggttcctctcacagcccatgcccccagtcagtgtggctgtgcctggcctgccctggggattgccgggttagggacctcccctgggccaggagaaatgaaagaggctccattacccggtttcaggcaagggaggaggaaatgggtggctctccaagctgaggcaggggctggtcacccgaggactgggttgctgagcagttgctggggatgggtcaggtctcagtgcaaggttggccccccggtaccacacccaggcccaaagtgggtggggctcagggctcctcctgtccccacttctccagccttgcagtgaccggagaggcaggactttctcattgctctttgtgttttcggtttttgttttttttttttgagacagagtctcgctctgttgcccaggctggagtgcagtggtgcgatcttggctcactgcaaccttcgcctcctgggttctagtgatgctcccgcctcagcctcctgagtagctgggattacaggtgcctgccaccacacctggctaattttttgtatttttagtagagacggggtttcaccatgttgcccaggttcatctcaaactcctgagctcaggcaatccacccacctcagcctcccaaagtgctgggaatacaggcatgagccaccgcgcccggccaggctttgtgttttcaaaggaaacaattataatgagatcttatagaaatgtccctaaacgtttggcgcctgcctttcattttttaatttctccagatgaggcaagtcaccaaagaagacctctgtgggccgtcttctaaagggcagtccccggtccagccagggcccagcactgggcagcctccccaccagagcctggggcccagtgatctcgaaggggcatagaattcggcagtgccgtgctgctcactgctgcggtgtcacagagggaagggggcgtggggcagggtctggganacaccaggtgtccgcttcacctgtcccctcccgggggacactcgctgtgccctggtgtctaggtttctactggggttggtcacaggcacgtctgagctcagaccccagcccctccagaggtggagtgggtcccagtggaccaaggcctcgtgaatgtctcatcctaagttagcctgggctccccagggtggcctgggccccggggaaacacgggcactccatcaggcgggacattcccagggctcatggctcaggcccagaccgtccctgggcgcgtgcaggtgtgagcgattgcccggcgctgtgtggcccccggggctttgctgcccttctgtgggcatcatctccttcacacgtggacacccccgtggtgccagccggccggtgagacaggggcaataggcctcgggctgtagctgctgaagatgggggtggcctggtgtccgcaccagcagtgctgtgctgacctcagcaggcaggtgtgagtggtgaggccctttctccagcctgcctgcccagcacccagcgtctgtgccagctcaaggcggccccttcgcagaacgagactgcctcatgaaggccttttcttcttctttttttttttttgagacagagcagtctcactctgtcacccaggctggtgatctcggctcactgcaacctctgcctccggggttcaagtgattctcctgcctcagcctcccgagtagctgggattacaggcacccgccagcacacccggctaatttttatatttttagtagagatggggtttcgccatgttggccaggctggtctgagagagaactcctgacctcgtgatccgcctgcctcagcctcccaaagtgctgggatgacaggcgtgcgccactgcacccggcccgtgaaggtcttttctgaagggagctacctttgagaagtgcctgttgggacagaactccctgctctggtctgaccctctgcacgctagggtggtcctgcacctgtcggggagggggccaaggacacagcactgggctggggcagggctctgcgctggtgctgcctgccatcccagttctgccattcccccagcgcacccccgcacccgcccctccagctgatgcctgctccctctctctgcagaacgggctcatgtcggggctgatgcagatgctgctgctgaaggtgtctgcacacatcaccgagcagctgggcatggccccaggtggcgagttcagggaggccttcaaggaggtgggcacagggtgaggtagggggtggccacagggatgtggctcacaggggtggtccggggttcccantgctccccaacacccagcctctgctccaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccggcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggacagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaaactgaaataaattctaattttggaaactcc

SEQ ID NO: 459292 - DNA, 1389 bp, Homo sapiens
ggaagaactggagcaccgacctcaacatccaggcacgtggcccatgcccacgacgcccacgaccacggaggggacgcacttcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccggcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggacagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaaactgaaataaattctaattttggaaactcc

SEQ ID NO: 459293 - DNA, 1583 bp, Homo sapiens
gtccgttgagggcccgcgccgcatggaggccggctgaggagcgccgctgcctcgcctcggtacgccgcgcggcgcggacggcgcgctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccggcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggacagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaaactgaaataaattctaattttggaaactcc

SEQ ID NO: 459294 - DNA, 652 bp, Homo sapiens
aagtagctgggagtacaggcatgcgccaccacacttggctaattttaaaatgttttttttaaagatgcggtctcaccatattgtccagactggtcttgaactcctgggctcaagccatcctcccatcttggccttccaaagtgttgggattacaggcatgagccaccacatgtggccaggagttccagaccagcctgagcaacatagcgagaccctgtctctgtttgtgtgtgtgtggttggggttttgtttttttttttttttaaagaattatagctcagtcctatgattaggcaagttgagaaaatattgatgaagatcaggggtgctgaagcctggttcctggggtcgcttctgatctaggcggttcttgcctctggtgactggtgttaattggcaggagtgggaggagggaggacaagtggaagtctaggctggctgagctgttctgtctcgaaaagttcctaaaactgtgctgctttaaaaaaaaaaaaagtaatttatgagacacattctcaatttccattaatcatctcctaaagggggtaaaccaggaagccgctgggtgaaaacaggctgttggcaattcctgagtcatgtgacccattctctaaagactagaatatttaacttaaatcagtgagaaactctg

SEQ ID NO: 459295 - DNA, 3921 bp, Homo sapiens
  misc_feature (1955)..(1955): n is a, c, g, or t
cctgcgtagcgtgaccctgcgcagcctgggaggcgggtcttagctccaggtgcgtacggcatctgacttgacgtggcccacaactgaaaggtctggggagaaggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaacccccaggggagcccgatccctgggggaccctggcttcggactccagtatctgtcgtcgcagggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgcgggctcccacgccggaggcccagagcgaagaggagagatccgatgaggagccggaggccaaagaagaggaagaggaaaaaccacacatgcccacggaatttgattttgatgatgagccagtgacaccaaaggactccctgattgaccggagacgcaccccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctatcatctcttaaaaggaggggctgtagctgtagctcaacagttaggccccacttgaagggagaggcagaattgtactcacccagattggaaaatgaaagccagatgggtagaggtgccctcagttagcacctgtcccatctcgggccctccaactcctcccagtcccactccagtgcagccagctggctccaaggtagaaacccatgagcactcagggagcagtgtgccttcagctgcagcagaagcagcccggaggataaaatgagaaccagctgcacacgggccctttaactcccaagccccacccctgggcttggcctgccttgccctgccgggaagtgatccccaaggcagggtgagagttccccatctgaggcgtttgttgcagctacctgcacttctagatgtgagtacattgtnctagccccccaaaccccaaatcaggggcagatctttgtatcccttgaggctctctttagtcctgtcttgctttgaagggccttgcttctgctggggcagggaaaacatgtctgaatcagagtggggaaggaggatgggtggtggctttgcttttggaggtttcactttccaatagttgggagtcttctgggttttgaagtaaaggcagattaacaccaacaccggtcccccacccccctgcaactctcaggcctctctctgacttcagggtcccacctgggaaatcaggtggggaaccttacagggtcattcagaccccatcttagccctagatcggtgcttgctctactcacctgcactgtcctggggacctgggctctggcctgtcaccttgagctccaagaatgtgacctgtacccattcaggccccttaactctgacagatgagggtttcttactcctccatgcagggctgggccagctgttggtctcagtcgatcattcaggaagtcattagcagagtgatttccagaaggcgtagaatttagtgaccaaggttctttcctttttgggaggagaaagtgaaaactaggatgctcagctggacccaccagcctgagattctggggattttagagctgtcccttggggagccaagcacttgggggtggaggtgatagcgaggctgatggcccctgtgttctcagctctctgcctgggtagcccctgggtgatgggggagaggccagctgtcacgtggggtatcaggtggctctgccagaaactcccttggcacacagagcactgggtcggccctcgggtgtggctgtttgggcaggacagccctctgtatgtagccttgagcaggtaggggggccaccttgagtgggtggcccagagacagcctcagggctccaaggtaacggggtgctcaggttatcttgggtgctgccctcccaggttctgggggagcagaggctgggcgctggcccaacttacaggaaacactcacctttgaactgccattggcaccatctgggcagtacacagccccacccaggtcctctagttcttgttctcggcttagaatctttgtgtttctgcctgagaagccactgcctcctagtttgtggtctctacagttatagccaggttggacttccggctccgtcctttgataactgtgtgctcttgggcaaatttcttaacttgcaggttcttgtgaggataacatgagttaattgagggcacttaacactacctggcacagattaagctcatctgaagtgggagctgttacttaggggcgtttgcctagaacacagggtccagaggctctctcccggaaacttagacccagtgagtcagaagtgaggcctgcaaaaagcagcaggagtggggttaagaattccagcctagggctggatgcggtggctcaggcctgtaatcccagtactttgggaggcccgaatgggaggatggcttgaggccaggagttccagaccagcctgagcaacatagcgagaccctgtctctgtttgtgtgtgtgtggttggggttttgtttttttttttttttaaagaattatagctcagtcctatgattaggcaagttgagaaaatattgatgaagatcaggggtgctgaagcctggttcctggggtcgcttctgatctaggcggttcttgcctctggtgactggtgttaattggcaggagtgggaggagggaggacaagtggaagtctaggctggctgagctgttctgtctcgaaaagttcctaaaactgtgctgctttaaaaaaaaaaaaagtaatttatgagacacattctcaatttccattaatcatctcctaaagggggtaaaccaggaagccgctgggtgaaaacaggctgttggcaattcctgagtcatgtgacccattctctaaagactagaatatttaacttaaatcagtgagaaactctg

SEQ ID NO: 459296 - DNA, 1284 bp, Homo sapiens
cctgcgtagcgtgaccctgcgcagcctgggaggcgggtcttagctccaggtgcgtacggcatctgacttgacgtggcccacaactgaaaggtctggggagaaggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaacccccaggggagcccgatccctgggggaccctggcttcggactccagtatctgtcgtcgcagggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgcgggctcccacgccggaggcccagagcgaagaggagagatccgatgaggagccggaggccaaagaagaggaagaggaaaaaccacacatgcccacggaatttgattttgatgatgagccagtgacaccaaaggactccctgattgaccggagacgcaccccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattccatggtctgcttagggggatgtcgaactgtggagccgggctctctccagcaactgagaattggagataaagaactacgtccaagcgtcggaaagcc

SEQ ID NO: 459297 - DNA, 1002 bp, Homo sapiens
cctgcgtagcgtgaccctgcgcagcctgggaggcgggtcttagctccaggtgcgtacggcatctgacttgacgtggcccacaactgaaaggtctggggagaaggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaacccccaggggagcccgatccctgggggaccctggcttcggactccagtatctgtcgtcgcagggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgcgggctcccacgccggaggcccagagcgaagaggagagatccgatgaggagccgttaggccacatcgtcacgagtgatcatgggactacgtccactcactgcccagggcacttggacttggcatgattgagcctggttacagctatcggacttcccctgattgacccgcaaaccgcaccc

SEQ ID NO: 459298 - DNA, 1545 bp, Homo sapiens
cctgcgtagcgtgaccctgcgcagcctgggaggcgggtcttagctccaggtgcgtacggcatctgacttgacgtggcccacaactgaaaggtctggggagaaggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaacccccaggggagcccgatccctgggggaccctggcttcggactccagtatctgtcgtcgcagggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgcgggctcccacgccggaggcccagagcgaagaggagagatccgatgaggagccggaggccaaagaagaggaagaggaaaaaccacacatgcccacggaatttgattttgatgatgagccagtgacaccaaaggactccctgattgaccggagacgcaccccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctatcatctctta

SEQ ID NO: 459299 - DNA, 1552 bp, Homo sapiens
cctgcgtagcgtgaccctgcgcagcctgggaggcgggtcttagctccaggtgcgtacggcatctgacttgacgtggcccacaactgaaaggtctggggagaaggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaacccccaggggagcccgatccctgggggaccctggcttcggactccagtatctgtcgtcgcagggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgcgggctcccacgccggaggcccagagcgaagaggagagatccgatgaggagccggaggccaaagaagaggaagaggaaaaaccacacatgcccacggaatttgattttgatgatgagccagtgacaccaaaggactccctgattgaccggagacgcaccccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattggcccctgggcagaagggtggccagtgggcccagccctggggaggggatatccccccagtctgctcaggcccctcaagctcctggagacaaccacgtggtgcctgtactgcgctaactcctgattaatacaatggaagtttctgggcatttacaat

SEQ ID NO: 459300 - DNA, 1185 bp, Homo sapiens
agacagcgtggggtggggagggtcctcggggtccttggcagggcacgtgcgggaggaagtggagctgcctgtacgcgcggccctagtcggctcctcaacgtggagcgatgggaggccttgagaagaagaagtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagtcgagggtcagccaagccaagggaaacgccggtgagggccaaagcgttgagtcgcaaagtgatggcgaactgggagcccataaagtcagagggacccgggtaggcgccgtccccaaggcgagaggaccagaaggcaggtaataccccccgaggggaactataacagcggaagccaagacaagacaagagaggccaaacacagagaaaatagaagggccccaccatcatccaaaggagaagaggcaggagaacacacacagagagagagccacaacacacgacgtcgacgacgaaaccaacgcaccacaaaaacagcagcgaaaacagaagc

SEQ ID NO: 459301 - DNA, 988 bp, Homo sapiens
ccggaggctgaagtgggaggatcgtttgaggctgcagtgagctatgattgtgccactgtgctccaggctgagcaacagagaaagaccctgtccctttaaaaaaattaaaaatatattgtcagatgaccccggaaagaaggttcttcctgttgtacccctttccaccagctcctggtgaaggttctagtggcatccagctttcccaggtggtgtagggaaatggggcagttgccaaggctccttccagctctgggagtttaggattctcttatctcgagatttgtgggcccatgaaataatgttgttaaagcagggctagcgcatgttttctcaccatgaagtgggtcaggtagatttttttcctgtgagaatttgtgaccttttcttgaagctctgcttttaagggatatagctttgagttctgtgccccccaccctcccttctacacatacctcagcctgaccttcgccttccccctcacaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459302 - DNA, 734 bp, Homo sapiens
gggggaaggtctgtggtggcggggaacataaggccaaagaacagaggaaggaagggcagagcagccctcctggaggtagggaacaaagggaggaggagggctagtgggaccatgtgagacatcttgaggccattcacgttcctgcttaaagagcccgggaccagcgcagagggcctgatgcctgatctgtcaagtctgtccgaccgtgcctgtctgctgtccccccagctgttccagtggtggattggcaggaccgggtgcctacccggtactccttaccaaaggagcccctggtagtgcccacctagcccaggacaaggagtggaacgggagctgcagctgcagtggtcacgaaggcagcctggaggaggtggccatggaggatagccttcgttatcgtcagcctctgtttccaaggaaacaagactctaggtccactttgccgtccagacctgaagcggacccttcatacacagccctgtgatacttggagcctgcttgcctcaaaacactgcttgctttacacttcacctaactccacccttcccttcaattctttaataacctttccctttgttcagccagatcactatagttcctctgctgggtggtttccctcattggaataagtcaacaactgggtttgtttctggtggttttaggctgacttggcgaggactagcctaaaaattaacccaaaagagaaaaataaaattgtatgcatgaagatggca

SEQ ID NO: 459303 - DNA, 781 bp, Homo sapiens
gggggaaggtctgtggtggcggggaacataaggccaaagaacagaggaaggaagggcagagcagccctcctggaggtagggaacaaagggaggaggagggctagtgggaccatgtgagacatcttgaggccattcacgttcctgcttaaagagcccgggaccagcgcagagggcctgatgcctgatctgtcaagtctgtccgaccgtgcctgtctgctgtccccccagctgttccagtggtggattggcaggaccgggtgcctacccggtactccttaccaaaggagcccctggtagtgcccacctagcccaggacaaggagtggaacgggagctgcagctgcagtggtcacgaaggcagcctggaggaggtggccatggaggatagccttcgttatcgtcagcctctggtgagaagcagcagcatccttccagagagtcacttctgatccccaagtttccaaggaaacaagactctaggtccactttgccgtccagacctgaagcggacccttcatacacagccctgtgatacttggagcctgcttgcctcaaaacactgcttgctttacacttcacctaactccacccttcccttcaattctttaataacctttccctttgttcagccagatcactatagttcctctgctgggtggtttccctcattggaataagtcaacaactgggtttgtttctggtggttttaggctgacttggcgaggactagcctaaaaattaacccaaaagagaaaaataaaattgtatgcatgaagatggca

SEQ ID NO: 459304 - DNA, 2275 bp, Homo sapiens
agacagcgtggggtggggagggtcctcggggtccttggcagggcacgtgcgggaggaagtggagctgcctgtacgcgcggccctagtcggctcctcaacgtggagcgatgggaggccttgagaagaagaagtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459305 - DNA, 2887 bp, Homo sapiens
gggggaaggtctgtggtggcggggaacataaggccaaagaacagaggaaggaagggcagagcagccctcctggaggtagggaacaaagggaggaggagggctagtgggaccatgtgagacatcttgaggccattcacgttcctgcttaaagagcccgggaccagcgcagagggcctgatgcctgatctgtcaagtctgtccgaccgtgcctgtctgctgtccccccagctgttccagtggtggattggcaggaccgggtgcctacccggtactccttaccaaaggagcccctggtagtgcccacctagcccaggacaaggagtggaacgggagctgcagctgcagtggtcacgaaggcagcctggaggaggtggccatggaggatagccttcgttatcgtcagcctctggtgagaagcagcagcatccttccagagagtcacttctgatccccaagccgtataaccgcgaatgaaccaaagagaacccgaagccggtgggaactcagcgcagtctcaccctgcccctcgggaaccgcttctcagcagcggcagccgaagtctgacgacgcttagcaaccgttaccttgacaacgcaatcctatcgcgcaccatggagtgcggcgcccctctgcatcccagaaggcaccgcgctgtccctaagccttccgcccctctccgtcccaacatgcaacgaggctcacagtcaatgaatcgtcatcaggtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459306 - DNA, 2198 bp, Homo sapiens
agacagcgtggggtggggagggtcctcggggtccttggcagggcacgtgcgggaggaagtggagctgcctgtacgcgcggccctagtcggctcctcaacgtggagcgatgggaggccttgagaagaagaagtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459307 - DNA, 1559 bp, Homo sapiens
agacagcgtggggtggggagggtcctcggggtccttggcagggcacgtgcgggaggaagtggagctgcctgtacgcgcggccctagtcggctcctcaacgtggagcgatgggaggccttgagaagaagaagtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccacggacacctgtaatgagtcagaagacggagaggaagacggattgacgtgagagttcaggcagagcaaatatcacagtgcccggtgagatagcatcggca

SEQ ID NO: 459308 - DNA, 1425 bp, Homo sapiens
agccatcccccttcgtgcggtcttccacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459309 - DNA, 1175 bp, Homo sapiens
agacagcgtggggtggggagggtcctcggggtccttggcagggcacgtgcgggaggaagtggagctgcctgtacgcgcggccctagtcggctcctcaacgtggagcgatgggaggccttgagaagaagaagtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatgggagatgtcagcgcaggaggaagaccgcaggaaggagatctgcgatatggtttttggcattgatatggtttggctgcgtcctcatctaaatcccatcttgaattgtaattcccacatgtctagggagagactggtgggaggagactggatcatggggg

SEQ ID NO: 459310 - DNA, 889 bp, Homo sapiens
tcgtaccaccgttacgccctcaccgctacgccctcaccgctaccctccccgctaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459311 - DNA, 918 bp, Homo sapiens
acacgtatatgtgccatatggtgttttctgccaggaaatactaagaaacagcctgatatgtccagcgccaggggccggccccaccatggtgggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459312 - DNA, 1192 bp, Homo sapiens
gggggaaggtctgtggtggcggggaacataaggccaaagaacagaggaaggaagggcagagcagccctcctggaggtagggaacaaagggaggaggagggctagtgggaccatgtgagacatcttgaggccattcacgttcctgcttaaagagcccgggaccagcgcagagggcctgatgcctgatctgtcaagtctgtccgaccgtgcctgtctgctgtccccccagctgttccagtggtggattggcaggaccgggtgcctacccggtactccttaccaaaggagcccctggtagtgcccacctagcccaggacaaggagtggaacgggagctgcagctgcagtggtcacgaaggcagcctggaggaggtggccatggaggatagccttcgttatcgtcagcctctgccgtataaccgcgaatgaaccaaagagaacccgaagccggtgggaactcagcgcagtctcaccctgcccctcgggaaccgcttctcagcagcggcagccgaagtctgacgacgcttagcaaccgttaccttgacaacgcaatcctatcgcgcaccatggagtgcggcgcccctctgcatcccagaaggcaccgcgctgtccctaagccttccgcccctctccgtcccaacatgcaacgaggctcacagtcaatgaatcgtcatcaggtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459313 - DNA, 766 bp, Homo sapiens
gggggaaggtctgtggtggcggggaacataaggccaaagaacagaggaaggaagggcagagcagccctcctggaggtagggaacaaagggaggaggagggctagtgggaccatgtgagacatcttgaggccattcacgttcctgcttaaagagcccgggaccagcgcagagggcctgatgcctgatctgtcaagtctgtccgaccgtgcctgtctgctgtccccccagctgttccagtggtggattggcaggaccgggtgcctacccggtactccttaccaaaggagcccctggtagtgcccacctagcccaggacaaggagtggaacgggagctgcagctgcagtggtcacgaaggcagcctggaggaggtggccatggaggatagccttcgttatcgtcagcctctggtgagaagcagcagcatccttccagagagtcacttctgatccccaaggtagttagggtgtcgaagtaaaggagggagacacccccctgcctacctacctggactcagtgctagagggtgggggagtaggaataggaagacagcatatttcccatacatattagaaatactggtggctcatgcctgtaatcccagcactttgggaagccaaggcaggaggattgcttgagcccacaagtttgagaccagtctaggcaagatggtgagaccctgattctaaaaaacaaacaaaaccaaaaaatgccagggatggtggtgtgtgcctgtaagtctcagctaatcgagaggctacaagtgg

SEQ ID NO: 459314 - DNA, 765 bp, Homo sapiens
gggggaaggtctgtggtggcggggaacataaggccaaagaacagaggaaggaagggcagagcagccctcctggaggtagggaacaaagggaggaggagggctagtgggaccatgtgagacatcttgaggccattcacgttcctgcttaaagagcccgggaccagcgcagagggcctgatgcctgatctgtcaagtctgtccgaccgtgcctgtctgctgtccccccagctgttccagtggtggattggcaggaccgggtgcctacccggtactccttaccaaaggagcccctggtagtgcccacctagcccaggacaaggagtggaacgggagctgcagctgcagtggtcacgaaggcagcctggaggaggtggccatggaggatagccttcgttatcgtcagcctctgccgtataaccgcgaatgaaccaaagagaacccgaagccggtgggaactcagcgcagtctcaccctgcccctcgggaaccgcttctcagcagcggcagccgaagtctgacgacgcttagcaaccgttaccttgacaacgcaatcctatcgcgcaccatggagtgcggcgcccctctgcatcccagaaggcaccgcgctgtccctaagccttccgcccctctccgtcccaacatgcaacgaggctcacagtcaatgaatcgtcatcagggtgattacagaaaagcctgtatatccacgtttgttttaacacttaaagtgtttgtaaccattgtgagcgggaaagatctggaaagagtg

SEQ ID NO: 459315 - DNA, 526 bp, Homo sapiens
gctgaattgtcatcagagtttacataggaggcaacagagctcaggagtggggccttggagtttcctttgaaggcaggatccaggatctagaaggaagctggagtggacgttatctccagccctggccctccagtgggggtgggcagccctggtggtgcgaggcctggcccctttctcaacaggagatgtcagcgcaggaggaagaccgcaggaaggagctggaggcgcaggagaagcacaagaagctttttgagggcctgaagttcttcctgaaccgagaggtgccccgtgaggccctggccttcatcatcaggtagggaggctcaagggcccgctgacagcattggttcggccatgctctggtctgggtcctgccctggtgcccatcggtaacattgggatggtgtcagtttccacttcttatgaaacagtgtgtggaaagtgctcggcaccgcactgagcacataggaagtgctcagcagagggcggaactgccgtcattttattactagcttagcacagaagg

SEQ ID NO: 459316 - DNA, 2295 bp, Homo sapiens
agacagcgtggggtggggagggtcctcggggtccttggcagggcacgtgcgggaggaagtggagctgcctgtacgcgcggccctagtcggctcctcaacgtggagcgatgggaggccttgagaagaagaagtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459317 - DNA, 2255 bp, Homo sapiens
  misc_feature (24)..(24): n is a, c, g, or t
  misc_feature (44)..(44): n is a, c, g, or t
tcgacggcagtaacctcggggtanaggtagcgaggctgggtggnggtcggctcctcaacgtggagcgatgggaggccttgagaagaagaagtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459318 - DNA, 2840 bp, Homo sapiens
gggggaaggtctgtggtggcggggaacataaggccaaagaacagaggaaggaagggcagagcagccctcctggaggtagggaacaaagggaggaggagggctagtgggaccatgtgagacatcttgaggccattcacgttcctgcttaaagagcccgggaccagcgcagagggcctgatgcctgatctgtcaagtctgtccgaccgtgcctgtctgctgtccccccagctgttccagtggtggattggcaggaccgggtgcctacccggtactccttaccaaaggagcccctggtagtgcccacctagcccaggacaaggagtggaacgggagctgcagctgcagtggtcacgaaggcagcctggaggaggtggccatggaggatagccttcgttatcgtcagcctctgccgtataaccgcgaatgaaccaaagagaacccgaagccggtgggaactcagcgcagtctcaccctgcccctcgggaaccgcttctcagcagcggcagccgaagtctgacgacgcttagcaaccgttaccttgacaacgcaatcctatcgcgcaccatggagtgcggcgcccctctgcatcccagaaggcaccgcgctgtccctaagccttccgcccctctccgtcccaacatgcaacgaggctcacagtcaatgaatcgtcatcaggtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459319 - DNA, 2180 bp, Homo sapiens
agacagcgtggggtggggagggtcctcggggtccttggcagggcacgtgcgggaggaagtggagctgcctgtacgcgcggccctagtcggctcctcaacgtggagcgatgggaggccttgagaagaagaagtatgaacgaggctcggccaccaactacatcacccggaacaaagcccggaagaagctccagctgagcttggctgactttaggcggctgtgcattctgaagggcatttatccccatgaacccaaacacaagaagaaggttaacaagggttctacagcagcccgaacgttttaccttatcaaagacatcaggtttctcctccacgaacccattgtcaacaagttccgtgaatacaaggtgttcgtccggaagctccggaaggcttatgggaagagcgagtggaacactgtagagcgtttaaaggacaataagcccaactacaaactcgaccacatcatcaaggaacggtatcccacgttcatcgatgccctgcgggacctggacgatgccctctccatgtgcttcctgttttccaccttcccgcggactggcaagtgccacgtgcagaccattcagctgtgccgccggctcactgtggagttcatgcactacattatcgctgcccgtgccctgcgcaaggtcttcctgtccatcaaaggcatttactaccaggccgaggtactggggcagcccatcgtgtggatcactccctatgccttctcccatgaccacccgacagacgtggactacagggtcatggccaccttcaccgagttctacaccacgctgctgggctttgtcaacttccgcctttaccagttgctcaacctccactatcccccgaagctcgagggtcaggcccaagcagaggcaaaggccggtgagggcacctacgcgttggactccgagagttgtatggagaaactggcagccctcagtgccagcctggcccgcgtggtggtgcctgccacagaggaggaggccgaggtggatgagtttcccaccgatggggagatgtcagcgcaggaggaagaccgcaggaaggagctggaggcgcaggagaagcacaagaagctttttgagggcctgaagttcttcctgaaccgagaggtgccccgtgaggccctggccttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459320 - DNA, 1234 bp, Homo sapiens
aataaggctaagtacgaggcgggctgtaaatcggccgaggagtcttctgaaccgagaggtgcccgtggaggccctggcttcatcatcaggagttttggtggggaagtgtcctgggacaaatctttgtgcattggggccacctatgacgtcacagactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459321 - DNA, 1463 bp, Homo sapiens
tgtgtcatcccccttcgtggcaagggaacgtagagctatcgggggcagtccttgaggggtgccctgggcaggaggggctgcaagatttgcagggaggcagagttcccctcccagaatccaaaagccggtagggcggggggcaggcccctcgtttggcaactgagaagaagcggctttgggcggcaggatgctggtttatttactgtaggatctccagggccatcaaagccccctcgtgggatagggagactatttacacagccagggaggagggcagccaggaggcagagaccgggtcccgtatttccctctgcccgaatgaggaggggaggggcgtcctgggtcctgcagctgtagtcttggggttcagatggaaacttcatactcccgcatcacccatcagattgtcgaccggcctgggcagcagacctcagtcattggcaggtgctacgtgcagccccagtgggtgtttgactcagtgaacgccaggctccttctccccgtggcagagtacttctctggggtgcagctgcccccacacctttcaccctttgtgaccgagaaggaaggagattacgttccacctgagaagctgaagctgctggctctgcagcggggagaggacccaggaaacctgaatgagtcagaagaggaggaggaagaggacgacaacaacgaaggtgatggtgatgaagagggagaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459322 - DNA, 870 bp, Homo sapiens
gtgtcatcccccttcgtgtgtccatcccccttcgtgaatagatggtagacgatgggtaggtaggtggatggatagatggaggcatggatgagatggatggatgggtgaaaaatgaggaggaggaggaagatgcagaggctggttcagaaaaggaggaagaggcccggctggcagccctggaagagcagaggatggaggggaagaagcccagggtgatggcaggcaccttgaagctggaggataagcagcggctggcccaggaggaggagagtgaggccaagcgcctggccattatgatgatgaagaagcgggagaagtacctgtaccagaagatcatgtttggcaagaggcgaaaaatccgagaggccaacaagctggcggagaagcggaaagcccacgatgaggcggtgaggtctgagaagaaggccaagaaggcaaggccggagtgagtgcctgcggcccctcacagggctgaggccagcccctagcagctggatgtggcagaggcaggccagaggacctaagtgtgatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459323 - DNA, 468 bp, Homo sapiens
  misc_feature (24)..(24): n is a, c, g, or t
  misc_feature (44)..(44): n is a, c, g, or t
tcgacggcagtaacctcggggtanaggtagcgaggctgggtggnggtcggctcctcaacgtggagcgatgggaggccttgagaagaagaagtatgaacgaggctcggccaccaactacatcacccggaacaaagcccggaagaagctccagctgagcttggctgactttaggacccctcatgctctctggctgggccagtgggcagccctcgcttcccttggatggagctgccctgctggtgcctggtcagagaagaggcctctgtgcccagcctgattctctgctcccaggagccagtgacatgaggtgcagaggcccacccagccccctacctactgcccccattcatcctggctttccacagccccctcccacacagttggacccgtgattctcagggtgctgtgatggggtgagggtagggggagcatttgttattaaatgactggacttttgtgccaattgca

SEQ ID NO: 459324 - DNA, 391 bp, Homo sapiens
aaagcatgcaggtttaacgtgtctgagtgatagcacggggctgctggaagtttatagaagtgagcagaaagatgatctgagaactttaacttctgtattttcttatgctttccctgagtgcatttgtggaactcacagtggttgaggtcttcatggagccggtgatgctttagtaaaagaagtacaaactcaagatacctatgagagccaggtaggcaacaaatgagtgaagcaggcctagtgtaggacaatagggagtggcggagactgcagtaaattggagcatgttggccaaaaaaacagagctatctgaaaatcagattcagactaccagccaccttcccactgcagaccaaaattgtatatctaattgtgtttcagactgctaaat

SEQ ID NO: 459325 - DNA, 1047 bp, Homo sapiens
gcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgcaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggg

SEQ ID NO: 459326 - DNA, 958 bp, Homo sapiens
gcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttggtaagaaatttgtgggtattagtggcagcttgggttttgtgagtcgggttggtttggttagacctactcagtagtgagacccaaagccaacgtttccctcatccttccaaacagcgtttccctttgctatcattggaaaagtagaatgccaaaatagtgtcagatggtgcgaactatataaaaggacacagcttatttcctttggcggctactctggctaataatcttaaggtcaaagccagcaggagttttcatggtgctcacgttgtcccttcaccttttatttatttatttatttaaattttttgagacggagtttcactcttgttgcccaggctgcagtgcactggggcgatttcggctcactgcaccttctgcctcccgggtttaatagattttcctgcctcagcctcccgagtagctgtgactacaggagcccaccaccacacccagctaatttttgtatttttagtaaagacagggcttcactgtgtggccaggctg

SEQ ID NO: 459327 - DNA, 366 bp, Homo sapiens
gctcatctcacagaaacaaaagcaggtgctaaattgctcttatctggggtatgaaagcacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgataaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggg

SEQ ID NO: 459328 - DNA, 1297 bp, Homo sapiens
gcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggtgagggcgcaacccggggacctctgcacgccgttcttgtgcctggcagcttcgaagcccatgttggagcaccgacccggtgctgcgctgttccgggcccggatggttaccgtccaccctctttcccgaattgcctcctgggtccccttctcttctactccgcgagaatctcctgtccattctccgtgagggtgtttcagttcctcccgggaagcccagaatttaatatcttgcccaggcccttaggagagcgggagaccctgatgttggggttaccctgtgccagagttgtgaggtcagggcaggaattgtatgttctcggcggtggaaccaattctttttttcctctgcttcaccccaggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgcaa

SEQ ID NO: 459329 - DNA, 1386 bp, Homo sapiens
gcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggtgagggcgcaacccggggacctctgcacgccgttcttgtgcctggcagcttcgaagcccatgttggagcaccgacccggtgctgcgctgttccgggcccggatggttaccgtccaccctctttcccgaattgcctcctgggtccccttctcttctactccgcgagaatctcctgtccattctccgtgagggtgtttcagttcctcccgggaagcccagaatttaatatcttgcccaggcccttaggagagcgggagaccctgatgttggggttaccctgtgccagagttgtgaggtcagggcaggaattgtatgttctcggcggtggaaccaattctttttttcctctgcttcaccccaggattacaagggccagaagctagctgaacagatgtttcagggaattattcttttttctgcagtaagtattggttttacatttaatctccgcccccgcctccctcccaaccctcagtttgagtgtgtttaatatacttcatttgtctctagatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgcaa

SEQ ID NO: 459330 - DNA, 849 bp, Homo sapiens
gcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcactgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgcaa

SEQ ID NO: 459331 - DNA, 567 bp, Homo sapiens
gcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggcccaggcccgagagggatcctcta

SEQ ID NO: 459332 - DNA, 936 bp, Homo sapiens
gcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgcaa

SEQ ID NO: 459333 - DNA, 873 bp, Homo sapiens
gcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcagtaagtattggttttacatttaatctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgcaa

SEQ ID NO: 459334 - DNA, 2992 bp, Homo sapiens
gcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgcaaaagttctttgtctaaagggtcttctgttgattattctgcaaggaagataattaataaaagcctaagttagaagttcgtgcttctggccaggtgcagtggctctcacctataatcccagcacttgaggaggctaaggcaggaggatgacttgagcccaggagtttgagacatttcatggtatgtaattaatagttgtcattagaacattagttccatgagaacggggactttgttttgctcactgctgtctacccagtacatagaagagtacacgatgcattgttaagtacttaagatttattgaatgagaactgcattgtacaatatggtgccactagacacgtctatttaatttaaattaaaatataaaactctaaaactagccatgattcaaaggttcaatagctatatgtgactagtggctaccatataaaacatttccatcacaaagttccatttatcagatcttatatagaaccttgaataaaatttaatagacaagtgattttgtatttaacatttcacctttattgaatgcctataaggccatttgaataacggatcatgtacaaagcaacaggaaaaaaaaaactgcaagcagtaaaggttgtgcaggtgatattcagtaacactgcagtgtagccagagcaaggacataaaacttccttagctttgtaagtctgtggaaatcaaaacttctaaaagagaaaaccgaaatcagaattactgacactttaggccaggcatggtgcctcaagcctgtaatcccagcatttagggaggccaaggcatgagccaccacgcccagccaaatgtaactttaaacaagacaaaaagtttagcttgaggacaatttaatactaactagaaagacaaagctgaatacatgtaaacatgactttatctttatgaacagccattatgaagacaactcccgctataggtacatcagcatatttctctatatatgcagaaaggaatacactatgaaaacagacaagatatgaattaccaagataaactatctcagatataaaaaggaggagcaaggggtcaagctgaagaggtcaagggaaaaaggctgctctacaatgttagagcacacatgattttctaaaaataaaaacacaaaaatggaagaaataatgcattggtgaagttcaaccttttcaaccctttgccttctatggatcatccttgatgataggaaagtataagctaacatgacaaaggcaggtgtggcagagactggagtgctcactgaaatcatgagctactctacgttttccagcctctccgtagaatcacatgcctggggtatggctgtcagggatgtaagcctgaaaacaccctaatgaatcctgaggctctcttttctcacttcatcatggcatggaagccccgtgtagcaatcagtgtagctacataatagaaacagcccatgaccaggagtcactactcagaaaagagtgatgccaacaggagagctacatcaaatctagcatgagcaagaaataactctctgtagtgttaagccactgtgatttgcgggttttgtctgttgcatcaactagaaccaattttcatggagagggtgctttgcaacatataaagtgctgtggctttgtaaggttctaatattagagggaactgatgccttataaagtaaaaccgttcttcagagcagaatacctctgaaaataagaatatatatgtttttatataaactgattcacgcaaagaagagaaaaacctttgaaaacaaaggggaacaattaagatataatctgcttataataaaataccgaggaaagagctgcagaattgttaggtattcagttctaagaaaacaactgttatgactcctgttattgtttatatagtttgaaaacagacttcccttgtgattagatatttcacttatctttaagcaagtctcgcagcttgaataagcttgaattattgaaggaattttaaataaatatgatggccccctaaatccaggtgtcaatcttagcattattaatggggaaacaaccagatatgttagcaactg

SEQ ID NO: 459335 - DNA, 2479 bp, Homo sapiens
gcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgcaaaagttctttgtctaaagggtcttctgttgattattctgcaaggaagataattaataaaagcctaagttagaagttcgtgcttctggccaggtgcagtggctctcacctataatcccagcacttgaggaggctaaggcaggaggatgacttgagcccaggagtttgagacatttcatggtatgtaattaatagttgtcattagaacattagttccatgagaacggggactttgttttgctcactgctgtctacccagtacatagaagagtacacgatgcattgttaagtacttaagatttattgaatgagaactgcattgtacaatatggtgccactagacacgtctatttaatttaaattaaaatataaaactctaaaactagccatgattcaaaggttcaatagctatatgtgactagtggctaccatataaaacatttccatcacaaagttccatttatcagatcttatatagaaccttgaataaaatttaatagacaagtgattttgtatttaacatttcacctttattgaatgcctataaggccatttgaataacggatcatgtacaaagcaacaggaaaaaaaaaactgcaagcagtaaaggttgtgcaggtgatattcagtaacactgcagtgtagccagagcaaggacataaaacttccttagctttgtaagtctgtggaaatcaaaacttctaaaagagaaaaccgaaatcagaattactgacactttaggccaggcatggtgcctcaagcctgtaatcccagcatttagggaggccaaggcaggcagatcacctgaggtcaggagttcaagaccagcctggccaacatggtgaaactccatctctactaaaaataacgaaaatcagccaggcatggtggtgtgtgcctgtaatcccagctactcgggaggctgagggaggggaacttgaacccaggaggcgtaggctgcagtgagccaagatcgcaccactgtactccagcctgggcaacaagaagactccatctcaaaaaaaaaaaaaaaagaatgattgacattttagaaccaatgccaaaagagtaacacatcaaagtctctgaactgtggccaaaggtatattcggaagaaaattcacagtcttaaagatgagtttttaaattaatttaggaagatgaattaagcactcaagtaaaaacgataaaagtgggaagaaaaaatgtttaaacaaaataaaaatatacagtatggtaattaataagaaagtatgggggaagtcaggtgtggtggttcatgcctataatcccagcactttcagaggccgatgcaggaggactgcttgaatgcagtttgagaccagcctgggcaacacagacttcctctccacaaaaaattttaaaaattagccaggtgtggtggtgcatgcctgtggtcctagctacttgaggggctgaggtgggaggatcacttaagcccaggaggtcaaggctgcagtgagctatgatcacctcactgcactccaggctgggtgacagagcaagaccctgtctcaaaaaaaaa

SEQ ID NO: 459336 - DNA, 2938 bp, Homo sapiens
gcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctactaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgcaaaagttctttgtctaaagggtcttctgttgattattctgcaaggaagataattaataaaagcctaagttagaagttcgtgcttctggccaggtgcagtggctctcacctataatcccagcacttgaggaggctaaggcaggaggatgacttgagcccaggagtttgagacatttcatggtatgtaattaatagttgtcattagaacattagttccatgagaacggggactttgttttgctcactgctgtctacccagtacatagaagagtacacgatgcattgttaagtacttaagatttattgaatgagaactgcattgtacaatatggtgccactagacacgtctatttaatttaaattaaaatataaaactctaaaactagccatgattcaaaggttcaatagctatatgtgactagtggctaccatataaaacatttccatcacaaagttccatttatcagatcttatatagaaccttgaataaaatttaatagacaagtgattttgtatttaacatttcacctttattgaatgcctataaggccatttgaataacggatcatgtacaaagcaacaggaaaaaaaaaactgcaagcagtaaaggttgtgcaggtgatattcagtaacactgcagtgtagccagagcaaggacataaaacttccttagctttgtaagtctgtggaaatcaaaacttctaaaagagaaaaccgaaatcagaattactgacactttaggccaggcatggtgcctcaagcctgtaatcccagcatttagggaggccaaggcatgagccaccacgcccagccaaatgtaactttaaacaagacaaaaagtttagcttgaggacaatttaatactaactagaaagacaaagctgaatacatgtaaacatgactttatctttatgaacagccattatgaagacaactcccgctataggtacatcagcatatttctctatatatgcagaaaggaatacactatgaaaacagacaagatatgaattaccaagataaactatctcagatataaaaaggaggagcaaggggtcaagctgaagaggtcaagggaaaaaggctgctctacaatgttagagcacacatgattttctaaaaataaaaacacaaaaatggaagaaataatgcattggtgaagttcaaccttttcaaccctttgccttctatggatcatccttgatgataggaaagtataagctaacatgacaaaggcaggtgtggcagagactggagtgctcactgaaatcatgagctactctacgttttccagcctctccgtagaatcacatgcctggggtatggctgtcagggatgtaagcctgaaaacaccctaatgaatcctgaggctctcttttctcacttcatcatggcatggaagccccgtgtagcaatcagtgtagctacataatagaaacagcccatgaccaggagtcactactcagaaaagagtgatgccaacaggagagctacatcaaatctagcatgagcaagaaataactctctgtagtgttaagccactgtgatttgcgggttttgtctgttgcatcaactagaaccaattttcatggagagggtgctttgcaacatataaagtgctgtggctttgtaaggttctaatattagagggaactgatgccttataaagtaaaaccgttcttcagagcagaatacctctgaaaataagaatatatatgtttttatataaactgattcacgcaaagaagagaaaaacctttgaaaacaaaggggaacaattaagatataatctgcttataataaaataccgaggaaagagctgcagaattgttaggtattcagttctaagaaaacaactgttatgactcctgttattgtttatatagtttgaaaacagacttcccttgtgattagatatttcacttatctttaagcaagtctcgcagcttgaataagcttgaattattgaaggaattttaaataaatatgatggccccctaaatccaggtgtcaatcttagcattattaatggggaaacaaccagatatgttagcaactg

SEQ ID NO: 459337 - DNA, 494 bp, Homo sapiens
gtggaagccagtcagaagttttatgaaaacagcagcagcttgagacagcccatgctcacaagaggggacctgtcagttaagccctttcccctgaaagaagaatgacattaaaccaggccttgtggtgcacgcctggtgcatgcctgtagtcccagctacgtgggaggccgaggcaagaggatcgcttgagccccggaggctgagcttagagtttgggaaaatcacttcataacctttcacaagatctgaaagaaataagcttcacattctttccacactatgtttactttctcaactttacaagttcttttttgttgtgtttgtgtgtgatgtttgttttatatttgaaggaatatctttatcatttgttctcttatttaggatgaataaatttaaacatggctgtcattcagaaacagaaaagatttatagaaaaatacagagacattgttcttttctctgtaaggtctgtaagctgctcacagacatgcctg

SEQ ID NO: 459338 - DNA, 3300 bp, Homo sapiens
cggagcggagtcccagccggagccccagccggagcccgatccctagccctgcggccgcgcctccctcgccgtccccgcctggagcccggcgccgccgccgccctgccgcccccgccagccgcgccgtgacgcgggcatgagcctgctccgcggcgccgctgagcaggcgctcctggcccgggcctcggcgcccaggcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaa

SEQ ID NO: 459339 - DNA, 3249 bp, Homo sapiens
agggaaggaagaagggcgggaggaaggagggagggaagagggagagaggaggagtgtgggaagaggaaggaaaaaagagagcgagacagcgagaggaagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaa

SEQ ID NO: 459340 - DNA, 3494 bp, Homo sapiens
aagctctgtgcccacttgggacacaggtgcctcatgaattcatttcctcatttaaagtaggtagatttattctcatttttttccaatggggaaattaaggcacagggtcttaagcggcttgcccaggaccacacagccagctggattcacactccgggctgtgctatgtctgagctatgttggatgaacctgggggtccagtggcttcctgtaggcgtgttctgactgggggcttccacactgtagacccacagccagtggtcagcctgctaatcatcttggagaggaactcctgagctggtccttgctctgaggagaaggcagccccagaggcaggcggtgaagacagagctgagaaaattgacccatctctggctgccagagcccaggcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaa

SEQ ID NO: 459341 - DNA, 3156 bp, Homo sapiens
agggaaggaagaagggcgggaggaaggagggagggaagagggagagaggaggagtgtgggaagaggaaggaaaaaagagagcgagacagcgagaggaagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaatgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaa

SEQ ID NO: 459342 - DNA, 2846 bp, Homo sapiens
agggaaggaagaagggcgggaggaaggagggagggaagagggagagaggaggagtgtgggaagaggaaggaaaaaagagagcgagacagcgagaggaagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaagtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaa

SEQ ID NO: 459343 - DNA, 1820 bp, Homo sapiens
agggaaggaagaagggcgggaggaaggagggagggaagagggagagaggaggagtgtgggaagaggaaggaaaaaagagagcgagacagcgagaggaagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggcattgagataatgcagcgtcatctcatgcagcctcggtgcagacggtgactcaggcagaggggataaggtgggggcttatggcgtcgacgcagggcgcggtttaactggaagggtacctggacaatgttagagtgccgaggtgccctgtgtgtgttgtgccccctc

SEQ ID NO: 459344 - DNA, 2678 bp, Homo sapiens
catacgaagagcaagcatgtgcatgttgtgtcacacaatgcaccacctcattcattgctgtgaatgcttgatcaagtgaggatcacctgcacttctaaactgacacaatcaatgtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaa

SEQ ID NO: 459345 - DNA, 1897 bp, Homo sapiens
agggaaggaagaagggcgggaggaaggagggagggaagagggagagaggaggagtgtgggaagaggaaggaaaaaagagagcgagacagcgagaggaagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaa

SEQ ID NO: 459346 - DNA, 1642 bp, Homo sapiens
  misc_feature (43)..(43): n is a, c, g, or t
ccggggggggaggaaaaaaccaataggctaggtacgaggctgngtggttgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaa

SEQ ID NO: 459347 - DNA, 1317 bp, Homo sapiens
  misc_feature (79)..(79): n is a, c, g, or t
gggggggggggggggtttttttgggccccctttttggggaaaaatatttttaaaacccccccctttccccaaaaggggncccccaaaatttgggttggtagaaggggaaaaagggggcgctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaa

SEQ ID NO: 459348 - DNA, 3207 bp, Homo sapiens
cggagcggagtcccagccggagccccagccggagcccgatccctagccctgcggccgcgcctccctcgccgtccccgcctggagcccggcgccgccgccgccgcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaa

SEQ ID NO: 459349 - DNA, 3366 bp, Homo sapiens
agggaaggaagaagggcgggaggaaggagggagggaagagggagagaggaggagtgtgggaagaggaaggaaaaaagagagcgagacagcgagaggaagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgagtcgcttccatgccccacacccacctgccaggaggctttgtggaggatgaggcctattgggcaggggtcttttgacctagctctgagttctgagcctgcttctgtgcccacaggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaa

SEQ ID NO: 459350 - DNA, 3258 bp, Homo sapiens
attttaaaatgcaagctggccaggcacaatggctcacacctgtaatctcagcactttgggaggctgaggcaggagggtggtttgagcccaggagtttgagaccagcctgggcaacatagtgagacactgtctctacaaaaaataaaaaaaattgcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaa

SEQ ID NO: 459351 - DNA, 3368 bp, Homo sapiens
agggaaggaagaagggcgggaggaaggagggagggaagagggagagaggaggagtgtgggaagaggaaggaaaaaagagagcgagacagcgagaggaagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggacccccaactggtgaagaccccctagaagacaggagcagaggggatcaacttcatgatctcggcgaggctgtctgagagctgcctctattcctctgccaggcccccctgccaaagacagatctaccggaggtgctggctggtgttccggaaatcctccagcaaggggccccagcggctggagaagtatccagatgagaagtcggtgtgcctccggggctgccccaaggtgactgagatcagcaacgtcaagtgtgttacgcggctccccaaggagaccaagcggcaggcggtggccatcatattcactgatgactcggcacgtaccttcacctgcgactcagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaa

SEQ ID NO: 459352 - DNA, 3134 bp, Homo sapiens
agggaaggaagaagggcgggaggaaggagggagggaagagggagagaggaggagtgtgggaagaggaaggaaaaaagagagcgagacagcgagaggaagagaaagatgtcactgtctctaatctccctgtcatttttatttccagcaggcgcggggcgaaggagctgctagaacaatgctgaggcgggtgaggtgaggagcagcccctcgcggcagccccgacagagtgtctggaacaggtgattggaggagccggagacccaggcacctgggcatccttcccctcgcctctgccaggccccgcgcccctaaaaggtgggaaaaccatggcgaccaatttcagtgacatcgtcaagcaaggctacgtgaagatgaagagcaggaagctcgggatctaccggaggtgctggctggtgttccggaaatcctccagcaaggggccccagcggctggagaagtatccagatgagaagtcggtgtgcctccggggctgccccaagagctagaggcagaggagtggtacaagacactatctgtggagtgtctggggtcccgcctcaacgacatcagtctgggagaacctgacctcctggccccaggggtgcagtgtgaacagacagatcgcttcaatgtcttcctgctgccctgccccaacctggacgtgtatggcgagtgcaagctgcagatcacccacgagaacatctacctctgggacatccacaacccccgtgtgaagctcgtctcgtggcccctctgctcactgcgccgctatggccgggatgccacacgctttaccttcgaggctggccggatgtgtgatgctggggaaggactctataccttccagacacaagagggggagcagatttaccagcgcgtccacagtgccaccctggccatcgcagagcagcacaagcgggtcctgctggaaatggagaagaacgtgaggctgctgaacaagggcacggaacattactcgtatccctgcacacccacgaccatgctgccgcgcagtgcctactggcaccacatcactggttcccagaacatcgccgaagcctccagctatgctggtgaggggtatggggcagcccaggccagctcggaaacagacctcctcaacagattcatcctgctaaagccaaagcccagccagggggacagcagtgaggccaagaccccatcccagtgaccacagtgctggcgagcaccgatgactgctgggggctgcctgctgcggggctggctgcagtgtaccgtggacagcctcagggggctgtcggccaagagcctggagaaagggagcaagctgccccctccttgcccccaaggatgaggctggactgaggcaaagggctggccacaccacctgagcatgtgtgaggggttggagctaccgtgggactatatactgttaatgattttaatatatatggcttatgacatactctgtatcaatgagatcccctcaccctcaccccatccttccccaccaatacacacaaattttttaatcccatgaccaggccacggtcaaggctgtttttgagtatgagtgcagtcgtgtccatcctccatggcacagccctcctgctgccaggacctgcttgaactaccagggccacaggagggggataatcagagcttgaggctggcactctgactgctggcttttcccaaacagcccaagggccggaacagcaggtggcttctcagttcctctgggcctggagtgacacaggaaggatctgcacttcctctgtgctgcttgccagccttgcagttggagttttaagcagaggtgacatctggttgacgcctcaggtgaaaatctggttttaaaatgtaacttctgcacaggctccttcctgctttgtaggctgggaagatgcccctggggtaggggtgctgattacctcagccatgtggaggaaggctggagcttgttcctgccccaggaataggccaggagggaaggccgcagcaggactgccgtggggagcacccctgctgcccccctctcactgaccaggggtggacaatgcccaagcagagggagcccccttgccctgtttggccaccctctggccagccaaaagcactctgaaaccaagaccttcccatttcctcctccccacatggtgctgaggctccctgctgcaatgcaattaaagcaattgattttctagtgctggtatttgttgactaccatgcagaagggctatctttctattcacgtcaaacttttggttgtgtggggttttttgttgttttttgggttttgttttttaatactttagggtcctgatttgtgggaacagaccttcttgtaaataaccactatttgagttgtggcaggaggatgataaagcacgcggcccctcccaaaggagcccttgagctagggaggtggtgcagtcagcctcgctctcaacgtgacccggggaatgaccacccagagggatgagctagcctgtagaggggaactggggtccaaaggtctttggggagggaggcagagctggctggctcagctaagtggcacgatgacgcatgaaggagattatgttgtgctctttattgccaaaaataaacacttttaaaaagacaacttctgttaatcaataaatatcctttcctttctgtactggatctctggttttctccaggctgcctaattaactgctttgtgcatgttcctatctggagacagtgctgaggggttagggccagagccttcattaaggagaaatgaaatactcctcctgtgtatgtgggaggggcccttgctcctgcggctgcttccacccccacccccacccccacccccacccccaccaaactaaatgatcaggtcattggaggtgaaggggttcatgactgctggacagagaatgaaatatcatgtttatttggtggggaggggacagccagggtctaatgctattccaaaaggttacttctcaaattagggacacctgggaatttgaagcgctagcaggccagccctggggcaagaactggaagggtttataggccccctgaataaaggctatggcacttgatcctcaacaccagacatctaaggtacaactgaaaatgactcattttggacagaaagggtttagagtaaa

SEQ ID NO: 459353 - DNA, 2544 bp, Homo sapiens
actctacatgctttttattacaagactactgaccatacgaggaaaattcatcatctggtaactacacctaaagcacaagtatttggaaaaaaaaaaaggataaacagattcattaaattatatgattaaatcactgacccaatagaaaatttatataataaagccagaaaaaaagttgtaaaatatagtttacaataattattcacattcaaggctgtacatcaatacatacaacaacgtggccccgaacatgaattcaattcaaataattcatatattagaatttaaataacacagactgaactagaggccaacaatagccagcaaataaccttatataagaataaaaatacaaaagtgtatatcctagtatcattgcatttgttttcataagttcttttaatttttgctttgtctgtacatcacagttacagctacagaccaggtagagaatattacgcatgttctgcttgccacccacctgaaagacgtactagtcatttatcctattttatgttgtgaaggaacagctacagcagctctaaatactgtaacaatttaattttgccaacatccaacttacttacagtcgtaatagaggcttttaccagcacaatgacccctattcgtagtcattctgccaggtggttaggctatgtgggttacacagcttaaaaaaggtctgccttttgtaaaaagttctctgtacatagtttggtgtttcttcatatggaagaaatgagttacggggaaaattcaggtacacacgtaggctcgttcagttgctcaccacagccatctcaacagatgaaagtgctctttgttggaaacagcttcctcctcacaccagttctccacaggcagcctcatctacaaccctgcaattttgggccagaagtggtggcccctcagaggctctgaagtgcctccagccccgattcaggcacttgccacgtgtgctgcgtaagaagggacccccacccagtgagtcaacataggctcatgtcaagtttgaaaataactggggaaaagtgtatgacaacatcttccagaacaaagtaccttcaccgtattctcacagcagctgcgatctctgaagtctcagcagtgaccaccccgggtctgtcaaccagccaggcaagggggggccctcaggcttcagagggcaagaaaccaaattccgtgcaatttggccataatctctggtagagtgaagcagcactgaacacggtgcctagaaaaacctcctgcacgttcccctgcacaatcaatggaccccaactacagtggagaaatgaagaatccaaccaaatttgggtggtctggacttgctgccagccaggcaatctgcaacactgtgggcagggagttggggggggcggcctgaaatctacaccagctgggacaaccacgccctacaatgaaaaagccagcctggctgctgggctcttgtgaaccactaagacctgaaggtgggggggtggaagggggagacaaatgcactcttgtaaaacccaatcagctacgtggtttttttcaaagaggctttgctctgctactgattccaaatgtcctaatataccttctgagtctataaacttaattacaaatcactcactaagcatgtggcaaggtcagttcaacacttgttatctctgctgactgtgcagatgcaaattcagtaccattgtggacacgaagtacaagattctgccaagcgcttgaaagccacggcagcagggagggcagagagctgacatgcaggcagagccaggttcttgcaaccaaaacaaggaaattggctcttggaaaaaatcggccacagatggattgcagtagtgacatcctcttagcatttaaataaagagcggtcttattcagacattctttggaacacatggcttatcagaaaccgatttgttcagaatctgtaagacacaactaaggtggttctgctactggaagtgagcgtctacacatcaggtcgagagagagacagaaatatcttcaaaatgaacaaactctttcacctcaaaataccacttccaggcatctaagggggaaaaaagtaagaaatcagaagattttaaagatattcatcacagcattatttaaatagtggaaaaatcagaaaccgtcttaagtattttacagtagggaaatggtcagataaattatagtaaatggacaatgactaaatagtacaattgttaaaaacatgtttctgagaaactcatgacatgggaaaatgcttaaaatatcaagggagaagacgatgcaaacggtgtgtgtcggatgttcctattttagtttaaaaagtgaacaaatggcagggcaggatatacggcaaaatgctcacagtggtcttctctggccggtgagcctacagctgatcttgtcagagacaaacgttagttttactgagtcacccagagccctgtgctggtgcctgagggtttgttccatgggacagtctccacaattcctctggggaagggccacaaatcccacagtgtgtcccaagagggctggagtaggcggagt

SEQ ID NO: 459354 - DNA, 882 bp, Homo sapiens
actctacatgctttttattacaagactactgaccatacgaggaaaattcatcatctggtaactacacctaaagcacaagtatttggaaaaaaaaaaaggataaacagattcattaaattatatgattaaatcactgacccaatagaaaatttatataataaagccagaaaaaaagttgtaaaatatagtttacaataattattcacattcaaggctgtacatcaatacatacaacaacgtggccccgaacatgaattcaattcaaataattcatatattagaatttaaataacacagactgaactagaggccaacaatagccagcaaataaccttatataagaataaaaatacaaaagtgtatatcctagtatcattgcatttgttttcataagttcttttaatttttgctttgtctgtacatcacagttacagctacagaccaggtagagaatattacgcatgttctgcttgccacccacctgaaagacgtactagtcatttatcctattttatgttgtgaaggaacagctacagcagctctaaatactgtaacaatttaattttgccaacatccaacttacttacagtcgtaatagaggcttttaccagcacaatgacccctattcgtagtcattctgccaggtggttaggctatgtgggttacacagcttaaaaaaggtctgccttttgtaaaaagttctctgtacatagtttggtgtttcttcatatggaagaaatgagttacggggaaaattcaggtacacacgtaggctcgttcagttgctcaccacagccatctcaacagatgaaagtgctctttgttggaaacagcttcctcctcacaccagttctccacatctcctggggatactctagagtg

SEQ ID NO: 459355 - DNA, 391 bp, Homo sapiens
gcggccgcctactactactactaaattcgcggcccgtcgaccgcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattaga

SEQ ID NO: 459356 - DNA, 649 bp, Homo sapiens
gtcccggcgccagcggccgcgtcggcgcggatgtccccgcccgcctctggttcgggcctcagcgagattactggaggattagatccggatcccgtccccgggcagcggccgccgcggccagcgccgccccgcgagttgcgagctccgggctggccctgctctgacaggctcgccccgccccacacgacacgcctgccactcctgcccccaggtatgcgccgggagctcaggacggtcccgtcccctaagggcgcctcctccttcagcccccggatagggcgggaggaaagggggccgccccgaggctctcaagatgcagagctgcaaagccctgggcctgcgccctcgccctcctcggcaagtctccaacggctccccactgcaggcctcagcccctcggggaggtcctccctgacgcctcagctccacttgtactgaagttattggccaatgtctgtctgcccacactgaactccaggaggctgtgagctccacttcctgcaaggttctgcccggggccgtgccgagcccggacagtgcctagaatgggaatgaatgcatggacaagagcacgtgtgacggtttaagcgtgccactgcgtgtgcagtctatcagtggatatgattgtgtatgtgacagtgtgagatgg

SEQ ID NO: 459357 - DNA, 2247 bp, Homo sapiens
gtcccggcgccagcggccgcgtcggcgcggatgtccccgcccgcctctggttcgggcctcagcgagattactggaggattagatccggatcccgtccccgggcagcggccgccgcggccagcgccgccccgcgagttgcgagctccgggctggccctgctctgacaggctcgccccgccccacacgacacgcctgccactcctgcccccaggtcgctgaagagttcgaaaccgtgctcagcaccgcgtttggggcatgtgagaccgagaggctttgggaaactgacgccgctgtgagaacgagtttagcggagtctatggacgctgcgagcttgtggccacaagagggcgccccggagcacggcccagtccccgcccccgctggatggggcccggcctcttcccagcgttcctcctccggccccaggtcaccgccagcacgcgcctgcttcccgtctgcgcgagtccacgcagctccccagatcaagaagctgaggccccaggttacacactaaagtaaatggcagaggcagaaataacacctatgtcctcctgaccccaaggcatgttcttaaagttctggaaacctcctggaggcttccttgctgctcctctgggactgccaccctgggcagggtgttctgtggcccctcatcatcgtggttttgaaccacaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattaga

SEQ ID NO: 459358 - DNA, 1640 bp, Homo sapiens
ggtacggtccgagttttgggatagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattaga

SEQ ID NO: 459359 - DNA, 1645 bp, Homo sapiens
agactatgtataagtgcgatactgggtgtaatttcagtgacgagggcgtggtctctcattgttaccaaggtgcgttcatcgagcagcagtatgcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattaga

SEQ ID NO: 459360 - DNA, 1420 bp, Homo sapiens
ggacgcgtgggtcgacccacgcgtcgcggacgcgtgggtccagcacgcgcctgcttcccgtctgcgcgagtccacgcagctccccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattaga

SEQ ID NO: 459361 - DNA, 1651 bp, Homo sapiens
gtcccggcgccagcggccgcgtcggcgcggatgtccccgcccgcctctggttcgggcctcagcgagattactggaggattagatccggatcccgtccccgggcagcggccgccgcggccagcgccgccccgcgagttgcgagctccgggctggccctgctctgacaggctcgccccgccccacacgacacgcctgccactcctgcccccaggtcgctgaagagttcgaaaccgtgctcagcaccgcgtttggggcatgtgagaccgagaggctttgggaaactgacgccgctgtgagaacgagtttagcggagtctatggacgctgcgagcttgtggccacaagagggcgccccggagcacggcccagtccccgcccccgctggatggggcccggcctcttcccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagaccacccagtctcgacgattgtgacccgtcgctcgaggccaagcgttagtaggaccagcagatctga

SEQ ID NO: 459362 - DNA, 1621 bp, Homo sapiens
  misc_feature (93)..(93): n is a, c, g, or t
  misc_feature (105)..(105): n is a, c, g, or t
  misc_feature (232)..(232): n is a, c, g, or t
  misc_feature (245)..(245): n is a, c, g, or t
  misc_feature (294)..(296): n is a, c, g, or t
  misc_feature (306)..(306): n is a, c, g, or t
  misc_feature (366)..(366): n is a, c, g, or t
  misc_feature (444)..(444): n is a, c, g, or t
  misc_feature (465)..(466): n is a, c, g, or t
cccaccacccccctccttcccctctcccccactccacccacctccccacccccttcaccaccacaccaccaccacccatcccaccaaccctcnagcaccccaccnccaccatccacctccacccccaccccctcttcttcccacaccccctcccccccactccccaccctcccttctctttactcctcctccatcctattcccttctcctcccacacctcccacaacctccntacactccacacnctcccccaccctccctacccccctttccccattcacctcccacctctcnnncactccaacnaaccaccaccccctccccctattccccacctcccccctcccaccttcctcccccctctcntccatcccttccacctcccccccccccttttcatcactccatcactcactcccatctactccctccccttcctcaccncccctcgctcccacctccccnnctttctcccactcgcccccatctccactcacaaaatcaatcctgccaactatcccactctcaacactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattaga

SEQ ID NO: 459363 - DNA, 1695 bp, Homo sapiens
gtcccggcgccagcggccgcgtcggcgcggatgtccccgcccgcctctggttcgggcctcagcgagattactggaggattagatccggatcccgtccccgggcagcggccgccgcggccagcgccgccccgcgagttgcgagctccgggctggccctgctctgacaggctcgccccgccccacacgacacgcctgccactcctgcccccaggtcgctgaagagttcgaaaccgtgctcagcaccgcgtttggggcatgtgagaccgagaggctttgggaaactgacgccgctgtgagaacgagtttagcggagtctatggacgctgcgagcttgtggccacaagagggcgccccggagcacggcccagtccccgcccccgctggatggggcccggcctcttcccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttccccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattaga

SEQ ID NO: 459364 - DNA, 1039 bp, Homo sapiens
ggccatagccgattcctgagggaaaacccgcgccgggggcatgcagaacactggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattaga

SEQ ID NO: 459365 - DNA, 919 bp, Homo sapiens
tgtgcgttgtgtgtgtgacaagccctcacggtgctatgcaggagcggatgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattaga

SEQ ID NO: 459366 - DNA, 398 bp, Homo sapiens
tgtgaccgagtctcactctgtcacccaggctggagcacagtggcacgatctcggctcactgcaacctctgcctcccgggttcaagcgattctcctgctgagtagctgggactacaggcacgtgccaccacacctggctaatttttttttctttttagtagagacggggttccaccatgttggccagggtggtcttgaactcctgacctcaggtgatccacccgcctcggcctcccaaagtgctgggattacaggcgtgagccaccatgcctggccgataatttttcttaaacttttaattaaattgctaattcttgaagttggctttattgttcccatatttcagatcaagaagctgaggccccaggttacacactaaagtaaatggcagaggcagaa

SEQ ID NO: 459367 - DNA, 2053 bp, Homo sapiens
gtcccggcgccagcggccgcgtcggcgcggatgtccccgcccgcctctggttcgggcctcagcgagattactggaggattagatccggatcccgtccccgggcagcggccgccgcggccagcgccgccccgcgagttgcgagctccgggctggccctgctctgacaggctcgccccgccccacacgacacgcctgccactcctgcccccaggtcgctgaagagttcgaaaccgtgctcagcaccgcgtttggggcatgtgagaccgagaggctttgggaaactgacgccgctgtgagaacgagtttagcggagtctatggacgctgcgagcttgtggccacaagagggcgccccggagcacggcccagtccccgcccccgctggatggggcccggcctcttcccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattaga

SEQ ID NO: 459368 - DNA, 2085 bp, Homo sapiens
gtcccggcgccagcggccgcgtcggcgcggatgtccccgcccgcctctggttcgggcctcagcgagattactggaggattagatccggatcccgtccccgggcagcggccgccgcggccagcgccgccccgcgagttgcgagctccgggctggccctgctctgacaggctcgccccgccccacacgacacgcctgccactcctgcccccaggtcgctgaagagttcgaaaccgtgctcagcaccgcgtttggggcatgtgagaccgagaggctttgggaaactgacgccgctgtgagaacgagtttagcggagtctatggacgctgcgagcttgtggccacaagagggcgccccggagcacggcccagtccccgcccccgctggatggggcccggcctcttcccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattagaaaaaaaaaaaaaagggggcggcctaaaatacc

SEQ ID NO: 459369 - DNA, 1999 bp, Homo sapiens
gtcccggcgccagcggccgcgtcggcgcggatgtccccgcccgcctctggttcgggcctcagcgagattactggaggattagatccggatcccgtccccgggcagcggccgccgcggccagcgccgccccgcgagttgcgagctccgggctggccctgctctgacaggctcgccccgccccacacgacacgcctgccactcctgcccccaggtcgctgaagagttcgaaaccgtgctcagcaccgcgtttggggcatgtgagaccgagaggctttgggaaactgacgccgctgtgagaacgagtttagcggagtctatggacgctgcgagcttgtggccacaagagggcgccccggagcacggcccagtccccgcccccgctggatggggcccggcctcttcccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaacttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattaga

SEQ ID NO: 459370 - DNA, 1374 bp, Homo sapiens
ggtacggtccgagttttgggatagcacgcgcctgcttcccgtctgcgcgagtccacgcagctccccagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattaga

SEQ ID NO: 459371 - DNA, 1595 bp, Homo sapiens
  misc_feature (1574)..(1574): n is a, c, g, or t
gtcccggcgccagcggccgcgtcggcgcggatgtccccgcccgcctctggttcgggcctcagcgagattactggaggattagatccggatcccgtccccgggcagcggccgccgcggccagcgccgccccgcgagttgcgagctccgggctggccctgctctgacaggctcgccccgccccacacgacacgcctgccactcctgcccccaggtcgctgaagagttcgaaaccgtgctcagcaccgcgtttggggcatgtgagaccgagaggctttgggaaactgacgccgctgtgagaacgagtttagcggagtctatggacgctgcgagcttgtggccacaagagggcgccccggagcacggcccagtccccgcccccgctggatggggcccggcctcttcccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatcatcaccnggggatccttagataccagca

SEQ ID NO: 459372 - DNA, 1999 bp, Homo sapiens
gtcccggcgccagcggccgcgtcggcgcggatgtccccgcccgcctctggttcgggcctcagcgagattactggaggattagatccggatcccgtccccgggcagcggccgccgcggccagcgccgccccgcgagttgcgagctccgggctggccctgctctgacaggctcgccccgccccacacgacacgcctgccactcctgcccccaggtcgctgaagagttcgaaaccgtgctcagcaccgcgtttggggcatgtgagaccgagaggctttgggaaactgacgccgctgtgagaacgagtttagcggagtctatggacgctgcgagcttgtggccacaagagggcgccccggagcacggcccagtccccgcccccgctggatggggcccggcctcttcccagcgttcctcctccggccccaggtcaccgccagcacgcgcctgcttcccgtctgcgcgagtccacgcagctccccaggcccttcaccagcacagcagcagcaggcatggcagcaagcgtggagcagcgcgagggcaccatccaggtgcagggccaggccctcttcttccgagaggccctgcccggcagtgggcaggctcgcttctctgtactgctgctgcatggtattcgcttctcctccgagacctggcagaacctgggtacactgcacaggctggcccaggctggctaccgggctgtggccattgacctgccaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtgaagcccagcactgctgcagggggtgggctgcctgcctgctctgagctctctcttgcacgctctctcttctctcccaggctctggctcatgcacatgcaacaggtgcgtctgtctatatgtctgggttcttgtcttttgtggtctgtttgtcttttctacctctttctcttgcagtgatagactgagggggtaaaatcaagagaaaaaactctcaggaatcaaggaacataatcctgtggagggtaatccattacatgagcttctcctgttcttccactttcctgcctggctttcactccttcccctgctctgcccagcctttccctcccacccactcctccttctgcaaatgccctgaaggccagcccttaccccaacacccacttccccacctccttaggccccagatacatacatgcccacatgcacgcttacatgtttagagccatccttgtttccaaatatgacccttcgcttgagggcaactgcataggtacatctaactctggactggcatgcacattgtcatgtgcagctttgcatatacacacatgcatacatgagcctccacacaagcacttgcacacatgtggactcctaaccatgctaacctcactggctgggaaggtggggaccccatgggccagcccttgcaggaggcccttttgcaaggcttagggtgtggccagccctgaaagctacttggacacaggtttcagctggccccagcccagaagtgacccccagaaagggagggccaccgctttgccccctgcttttacccttccttctgggtgctctacacctcaggttaccaggcctgaggcatctcagccaagcttgtttcctgctctgaggcttgtggggtgggagccagagtggaggtcggtgaaataaagtgatgcaattaga

SEQ ID NO: 459373 - DNA, 207 bp, Homo sapiens
ctccagcctggacaacaagagctaaaactctgtctcagaaaaaaaaaaagccgagacgcatccagagctttcgtgaccggggactgttctgaagcaggcctcgtggatgacgtatccgacctgtcagccgctgagatgctgacacttcacaattggctttcattctatgagaagaattatgtgtgtgttggtaagtcgtccataggt

SEQ ID NO: 459374 - DNA, 1887 bp, Homo sapiens
ctcggccatcttagctgtagatagaggcggcaacctcggaagtgcggagcgggtgggcctatatagatgttgaggtgcggaggccgtgggcttttgttgggcctggctgtagccgcagcagcggtaatggcagcacggcttatgggctggtggggtccccgcgctggctttcgccttttcataccggaggagctgtctcgctaccgcggcggcccaggggacccgggcctgtacttggcgttgctcggccgtgtctacgatgtgtcctccggccggaggcactacgagcctgggtcccactatagcggcttcgcaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggaggttctggaaggactctggctatattctgcaaatgtggctcatgccccttaccgtggctcggcgttgtggtgcctgagggacagccggccacctgcccagtactggtcagcttttcaacactattccctttgacctactggccatcttcctcacagccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaacttaaggtggctgggcttgctgcttgtccagtggtttgtatgtccagcgtcatctggcaatgtcatacctgttacctcttgactacttgtgaaggtagatgggggcaaggagtgttcctacttcagacagagaagtgggaccagcactaccacagacagcgccacggcctctgtgcatcgcctcatcagagcttccacccagctccctttgccgctcagtctcaccctcaacatccaccagcttcctccctctctgtcactgtctcctttttctccatcattcatttcactaaatcgctttccagattcacagactagaaaatggaggctgcctccccttcactggcagacccgtactcactgcccctgtccccttcactggcagacccgtgctcactgcccctgtcccctcactg

SEQ ID NO: 459375 - DNA, 1257 bp, Homo sapiens
acaacctgcaagccaagaagtacgagaagggccaggcgcggtggctcacgcctgtaatcccagcactttgggaggccgagacgggtggatcacctgaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggaggttctggaaggactctggctatattctgcaaatgtggctcatgccccttaccgtggctcggcgttgtggtgcctgagggacagccggccacctgcccagtactggtcagcttttcaacactattccctttgacctactggccatcttcctcacagccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaactta

SEQ ID NO: 459376 - DNA, 1871 bp, Homo sapiens
gaatagggatgagccgcccagaaggagatggatgggcacctgcttcccccactcttagtcttgggagaggattactaagctgcttgctttggcctcagtttcgccatagccagtggttgcttgcaccatccttgaacaaccagctccagaagggcagcttccctgtctcactgtgttcgatgcatctggcttcagcacacagccagaagggcttgaagcctgaatttgtgtttcgacaaatccccttttatttggtcctctaggaggagacaaacttcgtgagtgagctgtctcccaggtggtagttatgctaatcaaaccactgtgtaggttactgcacttgctacttactgatgctacataagggacttgcttctcaaatgagacaacaccaaactgtgtcctaaagcagtgttaaagactctaaacactaggcccggcgcagtggctcacgactgtaataccagcactttgggaggctgaggcggttggatcacttgaggtcaggagttcaagaccagcctggccaacatggtgaaaccctgtctctactaaaaaatacaaaaattacctgggcgtggtggcacgcacctgtactcccagctactcaggaggctgaggcaggagaatcgcttcagcccgggagatggaggttgcagtgacctgagattgcgctactgcactccagcctcaacgaaagacactaaacactagattgcttcacaagtactgacaactgggatggccgtagccctttcttctatctatctgcagcccccacgtctcactggagtcctacttggacatgactgacttcctgaggaacaccagtatcacttcaccatcgaaacagggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggaggttctggaaggactctggctatattctgcaaatgtggctcatgccccttaccgtggctcggcgttgtggtgcctgagggacagccggccacctgcccagtactggtcagcttttcaacactattccctttgacctactggccatcttcctcacagccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaactta

SEQ ID NO: 459377 - DNA, 983 bp, Homo sapiens
ctcaggggctgagcgctgtagcctgctgccttgggaaacactctggtaggcttctacttttcagaaggcctggctctctgcttcctgctctccccttcccagagactcatgagttctcacatttaagaagtcctctttccgtctatccttagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggaggttctggaaggactctggctatattctgcaaatgtggctcatgccccttaccgtggctcggcgttgtggtgcctgagggacagccggccacctgcccagtactggtcagcttttcaacactattccctttgacctactggccatcttcctcacagccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaactta

SEQ ID NO: 459378 - DNA, 1274 bp, Homo sapiens
ctcggccatcttagctgtagatagaggcggcaacctcggaagtgcggagcgggtgggcctatatagatgttgaggtgcggaggccgtgggcttttgttgggcctggctgtagccgcagcagcggtaatggcagcacggcttatgggctggtggggtccccgcgctggctttcgccttttcataccggaggagctgtctcgctaccgcggcggcccaggggacccgggcctgtacttggcgttgctcggccgtgtctacgatgtgtcctccggccggaggcactacgagcctgggtcccactatagcggcttcgcaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggaggttctggaaggactctggctatattctgcaaatgtggctcatgccccttaccgtggctcggcgttgtggtgcctgagggacagccggccacctgcccagtactggtcagcttttcaacactattccctttgacctactggccatcttcctcacagccctcagatatcaacgggcacaaataagaccaactcaatttccacttgaatttacaaccaaaagcctgctgagttgattacagctgggccaatacagtacgaggcaataacaaattagtgtgggcgtgtgcagtctgggccctcggcgtgtgca

SEQ ID NO: 459379 - DNA, 1426 bp, Homo sapiens
ctcggccatcttagctgtagatagaggcggcaacctcggaagtgcggagcgggtgggcctatatagatgttgaggtgcggaggccgtgggcttttgttgggcctggctgtagccgcagcagcggtaatggcagcacggcttatgggctggtggggtccccgcgctggctttcgccttttcataccggaggagctgtctcgctaccgcggcggcccaggggacccgggcctgtacttggcgttgctcggccgtgtctacgatgtgtcctccggccggaggcactacgagcctgggtcccactatagcggcttcgcaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggaggttctggaaggactctggctatattctgcaaatgtggctcatgccccttaccgtggctcgcttttcaacactattccctttgacctactggccatcttcctcacagccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaactta

SEQ ID NO: 459380 - DNA, 1423 bp, Homo sapiens
ctcggccatcttagctgtagatagaggcggcaacctcggaagtgcggagcgggtgggcctatatagatgttgaggtgcggaggccgtgggcttttgttgggcctggctgtagccgcagcagcggtaatggcagcacggcttatgggctggtggggtccccgcgctggctttcgccttttcataccggaggagctgtctcgctaccgcggcggcccaggggacccgggcctgtacttggcgttgctcggccgtgtctacgatgtgtcctccggccggaggcactacgagcctgggtcccactatagcggcttcgcaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggaggttctggaaggactctggctatattctgcaaatgtggctcatgccccttaccgtggctcggcgttgtggtgcctgagggacagccggccacctgcccagtactggtcagcttttcaacactattccctttgaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaactta

SEQ ID NO: 459381 - DNA, 933 bp, Homo sapiens
ctcggccatcttagctgtagatagaggcggcaacctcggaagtgcggagcgggtgggcctatatagatgttgaggtgcggaggccgtgggcttttgttgggcctggctgtagccgcagcagcggtaatggcagcacggcttatgggctggtggggtccccgcgctggctttcgccttttcataccggaggagctgtctcgctaccgcggcggcccaggggacccgggcctgtacttggcgttgctcggccgtgtctacgatgtgtcctccggccggaggcactacgagcctgggtcccactatagcggcttcgcaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagaggtggagagagcggcttcctcctacctgacatttatatctgcctggtgctccagcaggaagagtgcgctcttgctgtcctgccgctgtatggccatgtgcagtagcgtctgcccatccgacatggtgtcattgatggcggctccagagcccagcagctgggctgcgatcgtgtgcatgcctgggaaacaagccccgatctcatccaggctcggcttttcccgcttcctcaacatcttactacaacagccagaccctctcagcttctcaaagccagcagttttccactgga

SEQ ID NO: 459382 - DNA, 400 bp, Homo sapiens
tctcgaggagtcccataatcacaaggtcgttcacaatgtcgtacgccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaactta

SEQ ID NO: 459383 - DNA, 417 bp, Homo sapiens
  misc_feature (3)..(3): n is a, c, g, or t
cancttcgtcactcggatctcgcggcggtatggatcctcggcgtgtgcagcaacaacttcggccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaactta

SEQ ID NO: 459384 - DNA, 509 bp, Homo sapiens
gagcgcgagcactagcgcgcgagagagagagcgagagcgcgcgcgccgatgacgtcacgctcggcgtctcggccatcttagctgtagatagaggcggcaacctcggaagtgcggagcgggtgggcctatatagatgttgaggtgcggaggccgtgggcttttgttgggcctggctgtagccgcagcagcggtaatggcagcacggcttatgggctggtggggtccccgcgctggctttcgccttttcataccggaggagctgtctcgctaccgcggcggcccaggggacccgggcctgtacttggcgttgctcggccgtgtctacgatgtgtcctccggccggaggcactacgagcctgggtcccactatagcggcttcgcaggtatcagcgaggctgctcacgcctttctctccgctggcgcgagccagtagccacctgcgcgtcgttcgttggttcattattcatctatttccccccccatccccaccccacatccatcaaacccgt

SEQ ID NO: 459385 - DNA, 703 bp, Homo sapiens
ctcggccatcttagctgtagatagaggcggcaacctcggaagtgcggagcgggtgggcctatatagatgttgaggtgcggaggccgtgggcttttgttgggcctggctgtagccgcagcagcggtaatggcagcacggcttatgggctggtggggtccccgcgctggctttcgccttttcataccggaggagctgtctcgctaccgcggcggcccaggggacccgggcctgtacttggcgttgctcggccgtgtctacgatgtgtcctccggccggaggcactacgagcctgggtcccactatagcggcttcgcaggccgagacgcatccagagctttcgtgaccggggactgttctgaagcaggcctcgtggatgacgtatccgacctgtcagccgctgagatgctgacaccaggtagaagctgcgatcaccagaggcttggaggccaacaaactacagctgcaagagaagcagacattcccgccgtgcaacgcggagtggagctcagccaggggcagccggctctggtgctcccagaagaggtaagcaggctccccttcttctcctttctgcctgtcccaaatccaactcctaggccatcctgcctgcagtattcagtgaattcaggaattgattgttaaccctggggagctttttcaaaatactgataataattctcaactttggctgcatattagatct

SEQ ID NO: 459386 - DNA, 1475 bp, Homo sapiens
ctcggccatcttagctgtagatagaggcggcaacctcggaagtgcggagcgggtgggcctatatagatgttgaggtgcggaggccgtgggcttttgttgggcctggctgtagccgcagcagcggtaatggcagcacggcttatgggctggtggggtccccgcgctggctttcgccttttcataccggaggagctgtctcgctaccgcggcggcccaggggacccgggcctgtacttggcgttgctcggccgtgtctacgatgtgtcctccggccggaggcactacgagcctgggtcccactatagcggcttcgcaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggaggttctggaaggactctggctatattctgcaaatgtggctcatgccccttaccgtggctcggcgttgtggtgcctgagggacagccggccacctgcccagtactggtcagcttttcaacactattccctttgacctactggccatcttcctcacagccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaactta

SEQ ID NO: 459387 - DNA, 1233 bp, Homo sapiens
ctcggccatcttagctgtagatagaggcggcaacctcggaagtgcggagcgggtgggcctatatagatgttgaggccgagacgcatccagagctttcgtgaccggggactgttctgaagcaggcctcgtggatgacgtatccgacctgtcagccgctgagatgctgacacttcacaattggctttcattctatgagaagaattatgtgtgtgttgggagggtgacaggacggttctacggagaggatgggctgcccaccccggcactgacccaggtagaagctgcgatcaccagaggcttggaggccaacaaactacagctgcaagagaagcagacattcccgccgtgcaacgcggagtggagctcagccaggggcagccggctctggtgctcccagaagagtggaggtgtgagcagagactggattggcgtccccaggaagctgtataagccaggtgctaaggagccccgctgcgtgtgtgtgagaaccaccggcccccctagtggccagatgccggacaaccctccacacagaaatcgtggggacctggaccacccaaacttggcagagtacacaggctgcccaccgctagccatcacatgctcctttccactctaagccgtagcctcttctgttaataacacacagagagctctgccaagcacctgagtaggcccttgacacttgtgtgccctgggatgcctcctggcgcgaatcaggaggttctggaaggactctggctatattctgcaaatgtggctcatgccccttaccgtggctcggcgttgtggtgcctgagggacagccggccacctgcccagtactggtcagcttttcaacactattccctttgacctactggccatcttcctcacagccctcagatatcaacgggcacaaataagaccaactcaatttccacttgaatttacaaccaaaagcctgctgagttgattacagctgggccaatacagtacgaggcaataacaaattagtgtgggttgattctggaattggaaaagcttttgcttgtatggatacagcaaatccagatgtctctgaacaaagcaacaatttaaagcaacgacattttctgtcctttaagcacttaaaatcaggtgtggtgtgttttcaaaggcagaagtctgcattttgagcaaaaggtggcttcccagctctaacaaggtaactggttagcatgacattaaagcttgggcaaggcttcaaactta

SEQ ID NO: 459388 - DNA, 449 bp, Homo sapiens
aagcacaaactgttgtgaagtgtgcatgcgagggatctaggttgtgtactccttatgagaatctaatgcctgatattctgttactgtttcccatcaccccagatggacagtctagttgcaggaaaacaagctcagagatcccactgagtctacgttatagtgagttgtagaatcatttcattatatattactatgtagtaataatagaaataaagtgcacaatatatgtaatgcacttgaatcatcctgaaattattccctcactcccagtctgtggaaaaattgtcttccacacattcactctgttttttggtagaggcagggtcttaatatattgcccaggctgatctcaaactcttggcctcaagtaatatacctctctcagcctcccaaagtgctgagattacaggcataagccaccaccctcaaccaagactttcttaaaccaa

SEQ ID NO: 459389 - DNA, 433 bp, Homo sapiens
tgacctgcactaccagcacaacctgggtgtcctcagcttgtgctgcccgtctcgaatgactggagtttcctgcttctgtcactacacctcccaccctctccatcacctgctctgctcttataaggatccgaagaaatggaataatcgtatcgctgatctacgtaaacaaattgaagaattgtctgaaagaaaatatgttatgtctaaactggaaaagtcctgtaatcttatgttcatgggcttttacacaatggagttactgttcatcatgggggtaccgtggacaagcccagagctgccggcgagtcatgccatccttacacgtttctccttggaagacgggaactgatgaatttggcagctgcagatttaggacctgatcaatcaggggtcactgcgacaacactgggagctgcagaatcccgggagcaca

SEQ ID NO: 459390 - DNA, 368 bp, Homo sapiens
cgaggcgctcgggatacggggtccacagtcttcgcctgatatcaggcgaagactgtgacagtcatgagccagcgcatctggccaccttattttctattactggctcaatgtaatggctccatctcaggaacagccaatgaaagagatgcacaggacaagagatggggcctcagtatgttgccacggctgaccttgaactcctgcactcaagggattttcctgccctggcctcccaaagtattggtattacaggcatgagccattgtgcccaccgtctctggttcttaaccttctacttccctcttccagttttaaagaatgcttgtaattacatgggctctcctagatactccaggacaatcttgttt

SEQ ID NO: 459391 - DNA, 243 bp, Homo sapiens
ccatgttggccaggctggtctcgaactcctgacctcaagtgatccaccctcctcggcctcccaaatgctggaatatagaaaatggatggacaataatcctcctgcctcagcctcacaagtagctgggactacaggtgcttgtcaccacacctcactaattttcccatttgtgttatatgtggattccacaggactgacttcgaaaacttgagtatgcatggattttggtatacacagaaatgg

SEQ ID NO: 459392 - DNA, 2491 bp, Homo sapiens
  misc_feature (2373)..(2373): n is a, c, g, or t
tgggattacaggtaagtgccaccacacccagctgatttttgtgttttttgtagagacgaggtttcgccatgtttcccagactgttctcaaactcctgagctcaaagcagtccacccaccttggcctcccaaagtgctgggattacaggtgtgagccaccttgctcattctagtttaaactttggagtggtttgtgtctcctgattggactcctgcaaatacagaattgatgctaggaagggtaccaggagatagacgcacacagatgggatttgggaataggtttggttatccaaggagcagtgctgagctccttgctaatgggatatgggatgctggtgatttccagtaagtgacctcaaaattactcaaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459393 - DNA, 3336 bp, Homo sapiens
  misc_feature (3218)..(3218): n is a, c, g, or t
agatgatgattattccccaccttctaagagacaaagaccaacgagccaccacagccaccggtcccagaacccgccaatgctggggaacggaaaatgagggagttcaactctggccctcacaatccagtggaggagacgaaactcagctgcctctgtccctctgggcacgcctcatgccaggtgcatctgtggacaggggccatgctcctgggcttccaaagttggagaaagctgccaggctcaggtctgaaggccagaattctacagtaagtcctactcagtcaaggtgggagcagggtcagtggcttccgaggctctgcgggagaatccgtttcctggccgtggaggtggcctgcactcctcagcttgtgctgcccgtctcgaatgactggagtttcctgcttctgtcactacacctcccaccctctccatcacctgctctgctcttataaggatccgaagaaatggaataatcgtatcgctgatctacgtaaacaaattgaagaattgtctgaaagaaaatatgttatgtctaaactggaaaagtcctgtaatcttatgttcatgggcttttacacaatggagttactgttcatcatgggggtaccgtggacaagcccagagctgccggcgagtcatgccatccttacacgtttctccttggaagacgtgaacttatgaattcaacaggtgaagatttacaacttgataaatcagcttcatgagagccacctgagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattctggacctaccatgaaagacttctgaatccaggaagagagactgactgggaaacatgttattcagatggggtcttcttatgttgcccaggctggtctcaaattcctaggctcaagtgattccgcccacctctgcctcccaaagtgctgggattacagtcatgagccagcgcatctggccaccttattttctattactggctcaatgtaatggctccatctcaggaacagccaatgaaagagatgcacaggacaaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459394 - DNA, 3200 bp, Homo sapiens
  misc_feature (3082)..(3082): n is a, c, g, or t
ctggggagtcaaagaagtcttccatgaggaggtgatgccaaagcggacaagtgacagagtcgaagctagctaggaagagagtagaggtttaaggggaagcgtattataagcagaggatatcacccacttcagagactcccagaggagaaagtgtgtgtgttcgaactggcttccgaggctctgcgggagaatccgtttcctggccgtggaggtggcctgcactcctcagcttgtgctgcccgtctcgaatgactggagtttcctgcttctgtcactacacctcccaccctctccatcacctgctctgctcttataaggatccgaagaaatggaataatcgtatcgctgatctacgtaaacaaattgaagaattgtctgaaagaaaatatgttatgtctaaactggaaaagtcctgtaatcttatgttcatgggcttttacacaatggagttactgttcatcatgggggtaccgtggacaagcccagagctgccggcgagtcatgccatccttacacgtttctccttggaagacgtgaacttatgaattcaacaggtgaagatttacaacttgataaatcagcttcatgagagccacctgagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattctggacctaccatgaaagacttctgaatccaggaagagagactgactgggaaacatgttattcagatggggtcttcttatgttgcccaggctggtctcaaattcctaggctcaagtgattccgcccacctctgcctcccaaagtgctgggattacagtcatgagccagcgcatctggccaccttattttctattactggctcaatgtaatggctccatctcaggaacagccaatgaaagagatgcacaggacaaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459395 - DNA, 3161 bp, Homo sapiens
  misc_feature (3043)..(3043): n is a, c, g, or t
tgacctgcactaccagcacaacctgggtgtcctcagcttgtgctgcccgtctcgaatgactggagtttcctgcttctgtcactacacctcccaccctctccatcacctgctctgctcttataaggatccgagtggagtcttgctctgtcatccaggctggcagtggcgtggtcttggctcactgcaacgtctgcctcctgggttcaagtgattctcctgcctcagcctcctgagtagctgggactacaggcgcctgccaccatgccctgctgttttgtatttttgagaaatggaataatcgtatcgctgatctacgtaaacaaattgaagaattgtctgaaagaaaatatgttatgtctaaactggaaaagtcctgtaatcttatgttcatgggcttttacacaatggagttactgttcatcatgggggtaccgtggacaagcccagagctgccggcgagtcatgccatccttacacgtttctccttggaagacgtgaacttatgaattcaacaggtgaagatttacaacttgataaatcagcttcatgagagccacctgagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattctggacctaccatgaaagacttctgaatccaggaagagagactgactgggaaacatgttattcagatggggtcttcttatgttgcccaggctggtctcaaattcctaggctcaagtgattccgcccacctctgcctcccaaagtgctgggattacagtcatgagccagcgcatctggccaccttattttctattactggctcaatgtaatggctccatctcaggaacagccaatgaaagagatgcacaggacaaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459396 - DNA, 2454 bp, Homo sapiens
  misc_feature (2336)..(2336): n is a, c, g, or t
ggtcctgccttgttgctcaggctggagtgcaatcatttttcacggtaaccttgaactcctggggccaagtgatccacccaccttggcctcccaaagtgctgggattacaggtgtgagccaccttgctcattctagtttaaactttggagtggtttgtgtctcctgattggactcctgcaaatacagaattgatgctaggaagggtaccaggagatagacgcacacagatgggatttgggaataggtttggttatccaaggagcagtgctgagctccttgctaatgggatatgggatgctggtgatttccagtaagtgacctcaaaattactcaaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459397 - DNA, 2202 bp, Homo sapiens
  misc_feature (2084)..(2084): n is a, c, g, or t
cgctatctcggctcagcgcaacctccacctgccgggttcaagcgattctcctgcctcagcctcccgagtaattgggattacaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459398 - DNA, 2646 bp, Homo sapiens
  misc_feature (2528)..(2528): n is a, c, g, or t
caacgatttttcaacaatgtaatttctcttttacagagccacctgagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattctggacctaccatgaaagacttctgaatccaggaagagagactgactgggaaacatgttattcagatggggtcttcttatgttgcccaggctggtctcaaattcctaggctcaagtgattccgcccacctctgcctcccaaagtgctgggattacagtcatgagccagcgcatctggccaccttattttctattactggctcaatgtaatggctccatctcaggaacagccaatgaaagagatgcacaggacaaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459399 - DNA, 3455 bp, Homo sapiens
  misc_feature (3337)..(3337): n is a, c, g, or t
agatgatgattattccccaccttctaagagacaaagaccaacgagccaccacagccaccggtcccagaacccgccaatgctggggaacggaaaatgagggagttcaactctggccctcacaatccagtggaggagacgaaactcagctgcctctgtccctctgggcacgcctcatgccaggtgcatctgtggacaggggccatgctcctgggcttccaaagttggagaaagctgccaggctcaggtctgaaggccagaattctacagtaagtcctactcagtcaaggtgggagcagggtcagtggcttccgaggctctgcgggagaatccgtttcctggccgtggaggtggcctgcactcctcagcttgtgctgcccgtctcgaatgactggagtttcctgcttctgtcactacacctcccaccctctccatcacctgctctgctcttataaggatccgaagaaatggaataatcgtatcgctgatctacgtaaacaaattgaagaattgtctgaaagaaaatatgttatgtctaaactggaaaagtcctgtaatcttatgttcatgggcttttacacaatggagttactgttcatcatgggggtaccgtggacaagcccagagctgccggcgagtcatgccatccttacacgtttctccttggaagacgtgaacttatgaattcaacaggtgaagatttacaacttgataaatcagcttcatgagagccacctgagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattctggacctaccatgaaagacttctgaatccaggaagagagactgactgggaaacatgttattcagatggggtcttcttatgttgcccaggctggtctcaaattcctaggctcaagtgattccgcccacctctgcctcccaaagtgctgggattacagtcatgagccagcgcatctggccaccttattttctattactggctcaatgtaatggctccatctcaggaacagccaatgaaagagatgcacaggacaaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcaggagatggggtctcaccctgtcacccaggcttgactacagtagtgctatcacagctcactgcagccttgaactcctgggctaaggatcctcctacctgagcctcctgagtagctaggactggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459400 - DNA, 1331 bp, Homo sapiens
tgggattacaggtaagtgccaccacacccagctgatttttgtgttttttgtagagacgaggtttcgccatgtttcccagactgttctcaaactcctgagctcaaagcagtccacccaccttggcctcccaaagtgctgggattacaggtgtgagccaccttgctcattctagtttaaactttggagtggtttgtgtctcctgattggactcctgcaaatacagaattgatgctaggaagggtaccaggagatagacgcacacagatgggatttgggaataggtttggttatccaaggagcagtgctgagctccttgctaatgggatatgggatgctggtgatttccagtaagtgacctcaaaattactcaaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcatctgcctcactgtggaccccccaagccaagctcccaacctttcagcagcttctacacacccagctcctgccacccagtggcctc

SEQ ID NO: 459401 - DNA, 3283 bp, Homo sapiens
  misc_feature (3165)..(3165): n is a, c, g, or t
agatgatgattattccccaccttctaagagacaaagaccaacgagccaccacagccaccggtcccagaacccgccaatgctggggaacggaaaatgagggagttcaactctggccctcacaatccagtggaggagacgaaactcagctgcctctgtccctctgggcacgcctcatgccaggtgcatctgtggacaggggccatgctcctgggcttccaaagttggagaaagctgccaggctcaggtctgaaggccagaattctacagtaagtcctactcagtcaaggtgggagcagggtcagtggcttccgaggctctgcgggagaatccgtttcctggccgtggaggtggcctgcactcctcagcttgtgctgcccgtctcgaatgactggagtttcctgcttctgtcactacacctcccaccctctccatcacctgctctgctcttataaggatccgaagaaatggaataatcgtatcgctgatctacgtaaacaaattgaagaattgtctgaaagaaaatatgttatgtctaaactggaaaagtcctgtaatcttatgttcatgggcttttacacaatggagttactgttcatcatgggggtaccgtggacaagcccagagctgccggcgagtcatgccatccttacacgtttctccttggaagacgtgaacttatgaattcaacaggtgaagatttacaacttgataaatcagcttcatgagagccacctgagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattctggacctaccatgaaagacttctgaatccaggaagagagactgactgggaaacatgttattcagatggggtcttcttatgttgcccaggctggtctcaaattcctaggctcaagtgattccgcccacctctgcctcccaaagtgctgggattacagtcatgagccagcgcatctggccaccttattttctattactggctcaatgtaatggctccatctcaggaacagccaatgaaagagatgcacaggacaagaaacaggaccttgccctgtcactcaggatggagttcagtggtccaattatggctcattgtagcctcaaactcccaggctcaagcagtcctaccatgtcagccttcccagtagctgggaccacagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459402 - DNA, 2005 bp, Homo sapiens
  misc_feature (1887)..(1887): n is a, c, g, or t
cccgcgtgatctagagatcccccggtacgagcggtctcaccacagtgccacagatgctgtgagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459403 - DNA, 2101 bp, Homo sapiens
  misc_feature (1983)..(1983): n is a, c, g, or t
aagcacaaactgttgtgaagtgtgcatgcgagggatctaggttgtgtactccttatgagaatctaatgcctgatattctgttactgtttcccatcaccccagatggacagtctagttgcaggaaaacaagctcagagatcccactgagtctacgttatactggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459404 - DNA, 3383 bp, Homo sapiens
  misc_feature (3265)..(3265): n is a, c, g, or t
agatgatgattattccccaccttctaagagacaaagaccaacgagccaccacagccaccggtcccagaacccgccaatgctggggaacggaaaatgagggagttcaactctggccctcacaatccagtggaggagacgaaactcagctgcctctgtccctctgggcacgcctcatgccaggtgcatctgtggacaggggccatgctcctgggcttccaaagttggagaaagctgccaggctcaggtctgaaggccagaattctacagtaagtcctactcagtcaaggtgggagcagggtcagtggcttccgaggctctgcgggagaatccgtttcctggccgtggaggtggcctgcactcctcagcttgtgctgcccgtctcgaatgactggagtttcctgcttctgtcactacacctcccaccctctccatcacctgctctgctcttataaggatccgaagaaatggaataatcgtatcgctgatctacgtaaacaaattgaagaattgtctgaaagaaaatatgttatgtctaaactggaaaagtcctgtaatcttatgttcatgggcttttacacaatggagttactgttcatcatgggggtaccgtggacaagcccagagctgccggcgagtcatgccatccttacacgtttctccttggaagacgtgaacttatgaattcaacaggtgaagatttacaacttgataaatcagcttcatgagagccacctgagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattctggacctaccatgaaagacttctgaatccaggaagagagactgactgggaaacatgttattcagatggggtcttcttatgttgcccaggctggtctcaaattcctaggctcaagtgattccgcccacctctgcctcccaaagtgctgggattacagtcatgagccagcgcatctggccaccttattttctattactggctcaatgtaatggctccatctcaggaacagccaatgaaagagatgcacaggacaaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcaggagatggggtctcaccctgtcacccaggcttgactacagtagtgctatcacagctcactgcagccttgaactcctgggctaaggatcctcctacctgagcctcctgagtagctaggactggtctccatctgttgtccaaggctggagtgtagtagtgctatcacagctgactgcagcctcaaccttccaggctgaagcgatcctcccatctcaacctcccacgtggctgagactacaggtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459405 - DNA, 3264 bp, Homo sapiens
  misc_feature (3146)..(3146): n is a, c, g, or t
agatgatgattattccccaccttctaagagacaaagaccaacgagccaccacagccaccggtcccagaacccgccaatgctggggaacggaaaatgagggagttcaactctggccctcacaatccagtggaggagacgaaactcagctgcctctgtccctctgggcacgcctcatgccaggtgcatctgtggacaggggccatgctcctgggcttccaaagttggagaaagctgccaggctcaggtctgaaggccagaattctacagtaagtcctactcagtcaaggtgggagcagggtcagtggcttccgaggctctgcgggagaatccgtttcctggccgtggaggtggcctgcactcctcagcttgtgctgcccgtctcgaatgactggagtttcctgcttctgtcactacacctcccaccctctccatcacctgctctgctcttataaggatccgaagaaatggaataatcgtatcgctgatctacgtaaacaaattgaagaattgtctgaaagaaaatatgttatgtctaaactggaaaagtcctgtaatcttatgttcatgggcttttacacaatggagttactgttcatcatgggggtaccgtggacaagcccagagctgccggcgagtcatgccatccttacacgtttctccttggaagacgtgaacttatgaattcaacaggtgaagatttacaacttgataaatcagcttcatgagagccacctgagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattctggacctaccatgaaagacttctgaatccaggaagagagactgactgggaaacatgttattcagatggggtcttcttatgttgcccaggctggtctcaaattcctaggctcaagtgattccgcccacctctgcctcccaaagtgctgggattacagtcatgagccagcgcatctggccaccttattttctattactggctcaatgtaatggctccatctcaggaacagccaatgaaagagatgcacaggacaaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459406 - DNA, 1786 bp, Homo sapiens
  misc_feature (1668)..(1668): n is a, c, g, or t
gttctagaggtcccgggcagtcgtgctggtgcttgccactatgcccaactaatatttggaattttcgtatacgtggattccagaggggtgacagtgaaacgtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459407 - DNA, 2223 bp, Homo sapiens
agatgatgattattccccaccttctaagagacaaagaccaacgagccaccacagccaccggtcccagaacccgccaatgctggggaacggaaaatgagggagttcaactctggccctcacaatccagtggaggagacgaaactcagctgcctctgtccctctgggcacgcctcatgccaggtgcatctgtggacaggggccatgctcctgggcttccaaagttggagaaagctgccaggctcaggtctgaaggccagaattctacagtaagtcctactcagtcaaggtgggagcagggtcagtggcttccgaggctctgcgggagaatccgtttcctggccgtggaggtggcctgcactcctcagcttgtgctgcccgtctcgaatgactggagtttcctgcttctgtcactacacctcccaccctctccatcacctgctctgctcttataaggatccgaagaaatggaataatcgtatcgctgatctacgtaaacaaattgaagaattgtctgaaagaaaatatgttatgtctaaactggaaaagtcctgtaatcttatgttcatgggcttttacacaatggagttactgttcatcatgggggtaccgtggacaagcccagagctgccggcgagtcatgccatccttacacgtttctccttggaagacgtgaacttatgaattcaacaggtgaagatttacaacttgataaatcagcttcatgagagccacctgagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattctggacctaccatgaaagacttctgaatccaggaagagagactgactgggaaacatgttattcagatggggtcttcttatgttgcccaggctggtctcaaattcctaggctcaagtgattccgcccacctctgcctcccaaagtgctgggattacagtcatgagccagcgcatctggccaccttattttctattactggctcaatgtaatggctccatctcaggaacagccaatgaaagagatgcacaggacaaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcaggagatggggtctcaccctgtcacccaggcttgactacagtagtgctatcacagctcactgcagccttgaactcctgggctaaggatcctcctacctgagcctcctgagtagctaggactggtctccatctgttgtccaaggctggagtgtagtagtgctatcacagctgactgcagcctcaaccttccaggctgaagcgatcctcccatctcaacctcccacgtggctgagactacaggtgggaccatccagttgcaggaaaacaagcttaagacgcccactgattctacattatgctcctacctcccggcagcctctccaggcccagaactttctccagtcagcctctacagaccaagctcatgactcacaatggcctatttaggcccataccctacgtcacggcagtctccgcagatgagcctactgccccacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgcctcacagcagattcttcacgcccagcatctgcctcactgtggaccccccaagccaagctcccaacctttcagcagcttctacacacccagctcctgccacccagtggcctc

SEQ ID NO: 459408 - DNA, 1888 bp, Homo sapiens
agatgatgattattccccaccttctaagagacaaagaccaacgagccaccacagccaccggtcccagaacccgccaatgctggggaacggaaaatgagggagttcaactctggccctcacaatccagtggaggagacgaaactcagctgcctctgtccctctgggcacgcctcatgccaggtgcatctgtggacaggggccatgctcctgggcttccaaagttggagaaagctgccaggctcaggtctgaaggccagaattctacagtaagtcctactcagtcaaggtgggagcagggtcagtggcttccgaggctctgcgggagaatccgtttcctggccgtggaggtggcctgcactcctcagcttgtgctgcccgtctcgaatgactggagtttcctgcttctgtcactacacctcccaccctctccatcacctgctctgctcttataaggatccgaagaaatggaataatcgtatcgctgatctacgtaaacaaattgaagaattgtctgaaagaaaatatgttatgtctaaactggaaaagtcctgtaatcttatgttcatgggcttttacacaatggagttactgttcatcatgggggtaccgtggacaagcccagagctgccggcgagtcatgccatccttacacgtttctccttggaagacgtgaacttatgaattcaacaggtgaagatttacaacttgataaatcagcttcatgagagccacctgagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattctggacctaccatgaaagacttctgaatccaggaagagagactgactgggaaacatgttattcagatggggtcttcttatgttgcccaggctggtctcaaattcctaggctcaagtgattccgcccacctctgcctcccaaagtgctgggattacagtcatgagccagcgcatctggccaccttattttctattactggctcaatgtaatggctccatctcaggaacagccaatgaaagagatgcacaggacaaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcaggagatggggtctcaccctgtcacccaggcttgactacagtagtgctatcacagctcactgcagccttgaactcctgggctaaggatcctcctacctgagcctcctgagtagctaggactggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaacgtgggaccatccagttgcaggaaaacaagcttaagacgcccactgattctacattatgtcctaccctcacggcagcatctccagtccggggatcctctataatcatcgcagacattttt

SEQ ID NO: 459409 - DNA, 2145 bp, Homo sapiens
  misc_feature (2027)..(2027): n is a, c, g, or t
tcagcctgagccccttgcctcacaccggcccctcccacgcggacagaggtcagcctgagccccttgcctcacaccggcccctcccacgctgagagaggtcagtgtgagcccctgcctcaacaggccaccgtgagggaggagcagggtcgcacgcgggctgctgggaggtaggcagggacttgggcctgggaggtcgcggtggggcgagagctgggcctggagactcccctgggaggcaacagcggggtctgcagacacccttctccagctggagctgggactgttcagtcactgggagaagggatgtgggtctgaagagcttggttgcagaaacttcggggtctacaaaggccggcgggagctgagccaaaagagcttgtttgctgggaggcgggagatgcagccgggaggaacagctgggccatgcgggaggcagaggccgggcctcctcaagtcggcctctcagacccacttgcagcctcccagcgtcctctccgggcccagctcttcctcccggctgcgtctccaggccggactctggcccgactccaggtcccaacaacgtctttggactcagctcctgcccagctcccagaggccctggtaggcccacaacttccctaagccaagctccccaggcccagctcaggcctcacggtggcctctccaggctcagctcctgccctccgatggcatctgcaggccccaaacggcctccggtcggtgggcttctctaggcccagcttgggcctcccggtggcctctgcaggcccaaatcgtcccgaagtcggcctctccaggcccagctccggcctcccggcggcctctgcaggcccaagtcgtcctcaagtcggcctggaagtgggcctggaagagcagcaagtcggcctccccgggcccagctccgtcctctcggcggcctctccaggtgcaaaacttcctcgagtcagcctctccaggcccagctcttcctgcctcccagtggcctctttcggcccagcccagttcatggctctcggcggccttcccaggccccgcttttgacttttggcagcctcttcaggcgcagaacttgatctccagtcggcctttgcaggcccggcctcctgcctctcaaaggcctgcacgggcccggccttggccttggcctcacagtggactctccacgcccagctctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459410 - DNA, 1618 bp, Homo sapiens
  misc_feature (1500)..(1500): n is a, c, g, or t
tggcggccaatgtaggcccaaaacttcctcaagtcaaactctccaggcccaccttctgcttcccagtggcatgaacaggcccagctttgacttgagaacagcctctgcaggccctgctcttgcctcccaggggctttttccaggcccagctcttgcctcatggcagctgccccaggccaaatttctgcctgcctgccagcagcctcaacaggcatagctcctccctcacagtggcccatttaggcccaactcatgactgtcgggccatttccaggcctagtgcctgcctcgtggctgactcttgaagcccaaaacttcctcaaatcagccttttgcccaacttctgtctactgtcggactctacaggccaggcctctgcctcacagtggaccctccagacccagatggtgtctcactgtggcatcctcagtcgaagctcctgcctttcggcagcctctccaggcccagctcctcctgcctcccagtggcctctttcggcccagcccagctcatgcctcccggcggccttcccaagccccgcttttgacttttggtggcctctgcaggcctcgacaaggcccagcctcctgcctcccgaaggcctgcacaggcccagcctctgcctcacagcggactctccacgcccagctagctctcgcctcactgcggcctccccagtccaaagctcctgcctttcggccacttcggcaggtccagctactgcctgccagtggcctctttaggcccagctcattcctcacaacggcctttccaggccccgtttttcccttctggcagcctcttggcttctaatttgtttatcttttgtgtataaatcccaaaatatggaattttggaatatttccaccattatatattttggtcggtaatttatttggagtgagtttctgcaccatgcccgaactttttgttttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaacccttccgctgcctgtgtcgaagtgcaggagcccccacccccatactcacctgagtccagcccctctggggaaagaaggggtgcatgaactccccttagtccacaggcgcctccctgtggcccaaggccctcttcacactccatcttgtagccccagcaggagctattttccgaaaatgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459411 - DNA, 1707 bp, Homo sapiens
agatgatgattattccccaccttctaagagacaaagaccaacgagccaccacagccaccggtcccagaacccgccaatgctggggaacggaaaatgagggagttcaactctggccctcacaatccagtggaggagacgaaactcagctgcctctgtccctctgggcacgcctcatgccaggtgcatctgtggacaggggccatgctcctgggcttccaaagttggagaaagctgccaggctcaggtctgaaggccagaattctacagtaagtcctactcagtcaaggtgggagcagggtcagtggcttccgaggctctgcgggagaatccgtttcctggccgtggaggtggcctgcactcctcagcttgtgctgcccgtctcgaatgactggagtttcctgcttctgtcactacacctcccaccctctccatcacctgctctgctcttataaggatccgaagaaatggaataatcgtatcgctgatctacgtaaacaaattgaagaattgtctgaaagaaaatatgttatgtctaaactggaaaagtcctgtaatcttatgttcatgggcttttacacaatggagttactgttcatcatgggggtaccgtggacaagcccagagctgccggcgagtcatgccatccttacacgtttctccttggaagacgtgaacttatgaattcaacaggtgaagatttacaacttgataaatcagcttcatgagagccacctgagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattctggacctaccatgaaagacttctgaatccaggaagagagactgactgggaaacatgttattcagatggggtcttcttatgttgcccaggctggtctcaaattcctaggctcaagtgattccgcccacctctgcctcccaaagtgctgggattacagtcatgagccagcgcatctggccaccttattttctattactggctcaatgtaatggctccatctcaggaacagccaatgaaagagatgcacaggacaaggctaccacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgtatacgtggattccagaggggtgacagtgaaactaggtgacctcacagtgactcaagctaccacttactgttgattgtgacgaaatgcca

SEQ ID NO: 459412 - DNA, 1596 bp, Homo sapiens
agatgatgattattccccaccttctaagagacaaagaccaacgagccaccacagccaccggtcccagaacccgccaatgctggggaacggaaaatgagggagttcaactctggccctcacaatccagtggaggagacgaaactcagctgcctctgtccctctgggcacgcctcatgccaggtgcatctgtggacaggggccatgctcctgggcttccaaagttggagaaagctgccaggctcaggtctgaaggccagaattctacagtaagtcctactcagtcaaggtgggagcagggtcagtggcttccgaggctctgcgggagaatccgtttcctggccgtggaggtggcctgcactcctcagcttgtgctgcccgtctcgaatgactggagtttcctgcttctgtcactacacctcccaccctctccatcacctgctctgctcttataaggatccgaagaaatggaataatcgtatcgctgatctacgtaaacaaattgaagaattgtctgaaagaaaatatgttatgtctaaactggaaaagtcctgtaatcttatgttcatgggcttttacacaatggagttactgttcatcatgggggtaccgtggacaagcccagagctgccggcgagtcatgccatccttacacgtttctccttggaagacgtgaacttatgaattcaacaggtgaagatttacaacttgataaatcagcttcatgagagccacctgagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattctggacctaccatgaaagacttctgaatccaggaagagagactgactgggaaacatgttattcagatggggtcttcttatgttgcccaggctggtctcaaattcctaggctcaagtgattccgcccacctctgcctcccaaagtgctgggattacagtcatgagccagcgcatctggccaccttattttctattactggctcaatgtaatggctccatctcaggaacagccaatgaaagagatgcacaggacaagaaacaggaccttgccctgtcactcaggatggagttcagtggtccaattatggctcattgtagcctcaaactcccaggctcaagcagtcctaccatgtcagccttcccagtagctgggaccacaggtaagcatcgtgacactcagtgaattttgtttttatttttttgtagagatggggcctcagtatgttgccacggctgaccttgaactcctgcactcaagggattttcctgccctggcctcccaaagtattggtattacaggcatgagccattgtgcccaccgtctctggttcttaaccttctacttccctcttccagttttaaagaatgcttgtaattacatgggctctcctagatactccaggacaatcttgttt

SEQ ID NO: 459413 - DNA, 1406 bp, Homo sapiens
agatgatgattattccccaccttctaagagacaaagaccaacgagccaccacagccaccggtcccagaacccgccaatgctggggaacggaaaatgagggagttcaactctggccctcacaatccagtggaggagacgaaactcagctgcctctgtccctctgggcacgcctcatgccaggtgcatctgtggacaggggccatgctcctgggcttccaaagttggagaaagctgccaggctcaggtctgaaggccagaattctacagtaagtcctactcagtcaaggtgggagcagggtcagtggcttccgaggctctgcgggagaatccgtttcctggccgtggaggtggcctgcactcctcagcttgtgctgcccgtctcgaatgactggagtttcctgcttctgtcactacacctcccaccctctccatcacctgctctgctcttataaggatccgaagaaatggaataatcgtatcgctgatctacgtaaacaaattgaagaattgtctgaaagaaaatatgttatgtctaaactggaaaagtcctgtaatcttatgttcatgggcttttacacaatggagttactgttcatcatgggggtaccgtggacaagcccagagctgccggcgagtcatgccatccttacacgtttctccttggaagacgtgaacttatgaattcaacaggtgaagatttacaacttgataaatcagcttcatgagagccacctgagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattctggacctaccatgaaagacttctgaatccaggaagagagactgactgggaaacatgttattcagaaacaggaccttgccctgtcactcaggatggagttcagtggtccaattatggctcattgtagcctcaaactcccaggctcaagcagtcctaccatgtcagccttcccagtagctgggaccacaggtaagcatcgtgacactcagtgaattttgtttttatttttttgtagagatggggcctcagtatgttgccacggctgaccttgaactcctgcactcaagggattttcctgccctggcctcccaaagtattggtattacaggcatgagccattgtgcccaccgtctctggttcttaaccttctacttccctcttccagttttaaagaatgcttgtaattacatgggctctcctagatactccaggacaatcttgttt

SEQ ID NO: 459414 - DNA, 1236 bp, Homo sapiens
agatgatgattattccccaccttctaagagacaaagaccaacgagccaccacagccaccggtcccagaacccgccaatgctggggaacggaaaatgagggagttcaactctggccctcacaatccagtggaggagacgaaactcagctgcctctgtccctctgggcacgcctcatgccaggtgcatctgtggacaggggccatgctcctgggcttccaaagttggagaaagctgccaggctcaggtctgaaggccagaattctacagtaagtcctactcagtcaaggtgggagcagggtcagtggcttccgaggctctgcgggagaatccgtttcctggccgtggaggtggcctgcactcctcagcttgtgctgcccgtctcgaatgactggagtttcctgcttctgtcactacacctcccaccctctccatcacctgctctgctcttataaggatccgaagaaatggaataatcgtatcgctgatctacgtaaacaaattgaagaattgtctgaaagaaaatatgttatgtctaaactggaaaagtcctgtaatcttatgttcatgggcttttacacaatggagttactgttcatcatgggggtaccgtggacaagcccagagctgccggcgagtcatgccatccttacacgtttctccttggaagacgtgaacttatgaattcaacaggtgaagatttacaacttgataaatcagcttcatgagagccacctgagctgaagattcccttgagaacaagtactgtcctgtggtttcatggcctttcttccatttgtggttcttgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattctggacctaccatgaaagacttctgaatccaggaagagagactgactgggaaacatgttattcagagatggggcctcagtatgttgccacggctgaccttgaactcctgcactcaagggattttcctgccctggcctcccaaagtattggtattacaggcatgagccattgtgcccaccgtctctggttcttaaccttctacttccctcttccagttttaaagaatgcttgtaattacatgggctctcctagatactccaggacaatcttgttt

SEQ ID NO: 459415 - DNA, 698 bp, Homo sapiens
  misc_feature (580)..(580): n is a, c, g, or t
acccacgtgaagagttttcccagggacacccacgaccagtctgtggatctctggggaacccgtatctccttcgtaattagatagccctcccgtctttcttagaacccacctttgtttgttttttttgagacagagtctcgctctgtcacccaggctggtgtgaagtggtgcaatctcggctcactgcagcctctgcctcccgggttcaagtgattctcctgtctcagcctcccaagtagttgggattacagttgcctgccaccatgcctggctaatttttgtatttttagtagagaggggatttcaccatgttggccaggctggccttgaagtcctgacttcagataatctgcctgtctcagcttcccaaagtgctgggattacaggcgtgagccactgtgcccagctgagatctgatggttttaaaaagaggagctcccctgcatgagatctcactttttgcctgctaccatttatgtaagatgtgacttgctccttcttgccttccatcatgactgtgaagcttccccagccatatggaattgtaagttcaattaaacttcttttctttgtaaattcnaaagccctccctttacacttgcaaagggtcccaaaatacttccttgaggggggggccccgtaccccaattcgccctttggtggagtcgttttaacaattccctggcccgccgttttaa

SEQ ID NO: 459416 - DNA, 382 bp, Homo sapiens
tgcgaagtggaatttaaatgacatcttatcaagatggataaaccctagtttcccagtgctggaatatagaaaatggatggacaagtaaatctcactcagcacccatagtccaggcatggggacctcaacacacctgagccccagacatcacctttcattgtgagtagctctgagatgacacttctgctgttcccaattccagcattaattggattagatagttattttatgaagaattttcatatgccacaatcctgaccatatcttcaagtgaacagaaaaattctattaaaaagtcaaccttctgtctcactctgttgcccagactggagtgcagtggtgcaattatggctcactgcagcctcaacctcctgggctcaag

SEQ ID NO: 459417 - DNA, 325 bp, Homo sapiens
aatgtcttgagaattaatatgcactttaagattaaacataggtagtctaatcaaaatgtcaggattcctgtaatgctcataatttaaactgcttagttattggagtataaaaaaatttaaactctagactttagttttctgaaaatgaacattttctataatttgcatgaacttgagtcatatattgaatttaaaagctagttatatggtaataaaagcagaataacagtcaagttagagcatgagttctttcatttgtgaaggcaattaaaagtgtttccaaccagaaaagaataaatttatttttgcacagagaaggttttta

SEQ ID NO: 459418 - DNA, 2285 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctgctagccgccgtcgcctgcgcgctcaggcctctgggattagtagttttagcctcgtggatggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtctta

SEQ ID NO: 459419 - DNA, 2386 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtctta

SEQ ID NO: 459420 - DNA, 2532 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtcttaacccctgggtatttttctgttctccctccccatctactatcccaggcttgggcccaactggtcttccacgatgtcacctttgccctccaaggcagtcttccccaggtggtgcctctccccctactcagagcccagcctgtctttaa

SEQ ID NO: 459421 - DNA, 2703 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggtgcgagggacaaggatggggggtgcttggtgacaccacctgcccatcacaggctggatgcagggggtgccacacaaaacagaacagctttaggtcattatgcagaggaggtggccccaaaacagatttatctcctagatgtcatgatgggtgccctcagcagtggtgtcctggcctgacagaggccaaggaggggtcaaaggggccaggcagagaagagagggtctctcagtgaaaggaggggtttgggcagtgccctgttcagagccagcagagctcaagcatctaccacacaccctccaatgctcccattgcaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtctta

SEQ ID NO: 459422 - DNA, 2292 bp, Homo sapiens
  misc_feature (2228)..(2228): n is a, c, g, or t
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactaggggtttccttctttcttttaagctgtcccagatnccctagggggggggtctcgactgccacgggcgggggacctgcggtgcggcctcggttacataag

SEQ ID NO: 459423 - DNA, 2523 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaaggtttgcacccttgggcacctttctcttccccctattcccatttcctggaggcctggaattctgtagaggccggaagaggacccccagccctttcccttcccagctccccagggtgtcactctctgtccccactctagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtctta

SEQ ID NO: 459424 - DNA, 2129 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtctta

SEQ ID NO: 459425 - DNA, 2669 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaaggtttgcacccttgggcacctttctcttccccctattcccatttcctggaggcctggaattctgtagaggccggaagaggacccccagccctttcccttcccagctccccagggtgtcactctctgtccccactctagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtcttaacccctgggtatttttctgttctccctccccatctactatcccaggcttgggcccaactggtcttccacgatgtcacctttgccctccaaggcagtcttccccaggtggtgcctctccccctactcagagcccagcctgtctttaa

SEQ ID NO: 459426 - DNA, 2469 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggtgaggggtctttgggcacaggtggtagagcatctagggctgtaactctgcctctgagctcccctgcctctctgtgctcctaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtctta

SEQ ID NO: 459427 - DNA, 2840 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggtgcgagggacaaggatggggggtgcttggtgacaccacctgcccatcacaggctggatgcagggggtgccacacaaaacagaacagctttaggtcattatgcagaggaggtggccccaaaacagatttatctcctagatgtcatgatgggtgccctcagcagtggtgtcctggcctgacagaggccaaggaggggtcaaaggggccaggcagagaagagagggtctctcagtgaaaggaggggtttgggcagtgccctgttcagagccagcagagctcaagcatctaccacacaccctccaatgctcccattgcaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaaggtttgcacccttgggcacctttctcttccccctattcccatttcctggaggcctggaattctgtagaggccggaagaggacccccagccctttcccttcccagctccccagggtgtcactctctgtccccactctagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtctta

SEQ ID NO: 459428 - DNA, 1813 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagactatgagctactccctacatctctgcctggcctgtctgttctcgtattactacacgacctg

SEQ ID NO: 459429 - DNA, 2552 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccacgtgagtgtgcctgtgccccatgaaacccttcctgcaccttatccctcagcagagtggtgggttccccctatcttcagcctcctttactctgaggggagtgagctccagggctgggaacccaggttcacccgctgaccgtggcattgcattgcccttctcccaacagtgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtctta

SEQ ID NO: 459430 - DNA, 2002 bp, Homo sapiens
tgcccaacttgagctcgctgcccactgcctgttgggagtccgcgctcccagcggtgacccggccagcccctccgggcctcagttgcctgctgggtggacaaactcaccggacagggcaggaagccagtcctcttgccaaaccctgatcctttcctggactggtcaaggaagttggcgggagtcctggcctgctccggtgaagagagggagggggctctgttgggaagctacctggttagggccttggcagcttggcaggcctgactccacaaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtctta

SEQ ID NO: 459431 - DNA, 2301 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtctta

SEQ ID NO: 459432 - DNA, 2566 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttggtgagagcgggtggaagtttgacaggggcttggtgagggctccatgggctgaggacaagaagcggtgctgaccaggtggccttgcagggggggatgtcgtggatgagcagggccagcaggaagaccttgaggaaaagctgaaggagtatgtggactgtctcacagacaagaggtacccctggctgccagccaactcctacacccagctccaagtgtgatcaagggagggctggcccatatgaccccccttctcgacctcccccagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtctta

SEQ ID NO: 459433 - DNA, 2869 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccacgtgagtgtgcctgtgccccatgaaacccttcctgcaccttatccctcagcagagtggtgggttccccctatcttcagcctcctttactctgaggggagtgagctccagggctgggaacccaggttcacccgctgaccgtggcattgcattgcccttctcccaacagtgtgcttctgcccttggcctgggctgctacgtggctgccgctgacatccaggacctggtctcttgccttgcctgcttagaaagtgttttcagccggttctatggcttggggggcagctccacaagtcctgtggttcctgccagcctgcacggcctgctctctgctgccctgcaggcctgggcattgctgctcaccatctgccctagcacccaaatcagccacatccttgacaggcagctgccccggctgccccagctcttgtccagtgaaagtgtgaacctgcggatcgctgccggtgaaaccattgcactgctctttgagcttgcccgggaccttgaggtgcgagggacaaggatggggggtgcttggtgacaccacctgcccatcacaggctggatgcagggggtgccacacaaaacagaacagctttaggtcattatgcagaggaggtggccccaaaacagatttatctcctagatgtcatgatgggtgccctcagcagtggtgtcctggcctgacagaggccaaggaggggtcaaaggggccaggcagagaagagagggtctctcagtgaaaggaggggtttgggcagtgccctgttcagagccagcagagctcaagcatctaccacacaccctccaatgctcccattgcaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtctta

SEQ ID NO: 459434 - DNA, 2384 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttggtgagagcgggtggaagtttgacaggggcttggtgagggctccatgggctgaggacaagaagcggtgctgaccaggtggccttgcagggggggatgtcgtggatgagcagggccagcaggaagaccttgaggaaaagctgaaggagtatgtggactgtctcacagacaagaggtacccctggctgccagccaactcctacacccagctccaagtgtgatcaagggagggctggcccatatgaccccccttctcgacctcccccagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactagggggcctttcccttcctttcctttctcaggccttgctcccccaggatgacccactcttaggggggtggtggcatctggacaaatgccaccacagcaggtggggtggcaaagctacctggaatggatttgtgtgctgatttttaaggattattacagataattaaacagaacggtcagccttctgtggtctta

SEQ ID NO: 459435 - DNA, 2110 bp, Homo sapiens
  misc_feature (2046)..(2046): n is a, c, g, or t
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcccttggcctgggctgctacgtggctgccgctgacatccaggcagctgccccggctgccccagctcttgtccagtgaaagtgtgaacctgcggatcgctgccggtgaaaccattgcactgctctttgagcttgcccgggaccttgaggaggagtttgtttacgaggacatggaggccctctgcagtgtcctgcgcactctggccactgacagtaacaagtaccgtgccaaggctgatcgtcggcgccagcgctctactttccgcgccgtgctgcactccgtggagggcggtgaatgcgaagaagagatagtgcgcttcggctttgaggtgctctacatggacagctgggctcggcaccggatctacgctgccttcaaggaagtgctgggttcgggcatgcaccaccacctccagaacaatgagctactccgtgacatctttggcctgggccctgtgctgttgctggatgccactgccctgaaggcctgcaaggttccacgctttgagaagcacctgtacaatgctgctgccttcaaagcccggaccaaggctcgaagccgtgtgcgggacaagcgggcagacatcctgtgaagcaggacctgctgaagaggagactttctatgcccttggtccgtatttttaacagaagacagtgcaacaactggtctccaccagtatttgtcactttattttttttaatgacaaaaccaaaaacagacatggggtgggtagctgggggcccggacacttgggaccctgacccctttgtccctgcactcagccctgtggccccttcctgtcctgtctcaggccaggctaaatatgtgccttcctcagggctgtggggcaggcactaggggtttccttctttcttttaagctgtcccagatnccctagggggggggtctcgactgccacgggcgggggacctgcggtgcggcctcggttacataag

SEQ ID NO: 459436 - DNA, 1415 bp, Homo sapiens
atgggccccaaaaaatcttggcgaagtcacttttttccactgcctgaggtttggctgttgctcctgttatcccaagctctaagcccttcccatggtccccagacccaggcaggggtaggtctcgtctggagtgtcccgctgccaagtgccctgagaagccagtcctgccttggtgctccactgagggacgcttcggagttaaccaccgtgcacttgttcccgacgcggggctggggcgcgcgcagggcattgtgggtgcatagttcagccagcgcgtcgtcggctggtgggccccaggcgtggactaccattcccatggtgctctacgcgcagctagccgccgtcgcctgcgcgctcaggcctctgggattagtagttttagcctcgtggatgtgggcctgaatcggatggcctggaactcgccttcccggcgacctgtttggcagggcggggcgcctcgcgaagatggtggcgcgcgcggcgtgtggctcccgtcgtctggccaagtctcagcgcagcgcaccggccggcgtctcgttggcctggagcccacacccaccgggtccctgaccccgcgccccccgcgcccggttcccggcatgcctcgcgcccgtaagggcaacacgctccggaagggtggtcagcgccgtggaggaggtgcccggagcagtgcccaagctgactcgggttccagtgacgatgaggcagccagtgaggcccgcagcaccgccagtgaatgccccagccttctcagcaccactgcagaggacagccttgggggggatgtcgtggatgagcagggccagcaggaagaccttgaggaaaagctgaaggagtatgtggactgtctcacagacaagagtgccaagacccggcagggtgctcttgagagcctgcgcctggccctagcgtcccgcctactccccgacttcttgctggagcgccgcctcacgctagccgatgccctggaaaagtgcctcaagaaagggaagggcgaggaacaagccctggctgctgctgtgctaggcctgctctgcgtgcagctgggccctggacctaagggtgaggagctgtttcacagcctgcagcctctgctggtctctgtgctcagtgacagcacagctagccctgctgcccggctccactgtgcttctgcctggctggctgtacgtggtgcgttgacatcaggactgttcttgctgctgctagaaggttcagccggctaaaggttgggggagtcacaatctgggtctgcagctgagctgcttgtgctgagctggcatgtggtccatttgcaaaccaatacatcttgaagctgccggccattgccagtgaccgaacggaaacgcttgtgcgcagaataaaccactgctcgggaaagaaagaacgggaaattttcccctatcctctccacc

SEQ ID NO: 459437 - DNA, 343 bp, Homo sapiens
agcagaggccagtgcgcaggctggactttgtcctgcagatgaggggtgtgagtagttcttagaagtagggccagcctggtgatcacaccctgtccaaaactctgccacagcagccaaccttgccaatgtcagcccttggccctggacagaccccacacacaggagtgcaccagccctactgaactgacccttggctttggtttttcatctctgagagggacaccattctatcttttgggattatgaggtcgagtgaggtacccccagccatccctcatcagtagaggcaagttgagtgtcctattccaccttctccaggtgcccggagcagtgcccaagctga

SEQ ID NO: 459438 - DNA, 1954 bp, Homo sapiens
  misc_feature (1472)..(1472): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaatt

SEQ ID NO: 459439 - DNA, 566 bp, Homo sapiens
caagacctttgacaatttcaaagggttttttccgccctggggtttcctaaggaaggggggaaaaaggggccccgttaccaagcccaggaaaattttggattctttagtaaaaaccccatctctactaaaaatagaaaattagccaggtgtggtggtagatacgtgtaatctcagtcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaatt

SEQ ID NO: 459440 - DNA, 8839 bp, Homo sapiens
  misc_feature (1472)..(1472): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459441 - DNA, 8386 bp, Homo sapiens
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagtcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459442 - DNA, 9105 bp, Homo sapiens
  misc_feature (1472)..(1472): n is a, c, g, or t
  misc_feature (8983)..(8983): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgcaaaaaaaaaaaaaaatgctagtgacttcagcaagtcataatcttcctgcgggtggagggtctcactgcgatgtggatggccgctggggctgaccagggtggtggtggcagaaggctggggcggctgtggcagtttcttaaaatangacaacaatgacatttgccacattgatagacttttcttttcacaaaagaagtctctgtagcacgtggttgctgttggtgcactttacccacagtggaacttctttcaaatagtctcaatcct

SEQ ID NO: 459443 - DNA, 8153 bp, Homo sapiens
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459444 - DNA, 9090 bp, Homo sapiens
  misc_feature (1472)..(1472): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgcaaaaaaaaaaaaaaaaaaaaaaaaaaaaaaaaaaaaaaaaaaaaaaaaaaaaaaaaaaaaaaaaaaataaaaaaacaaaaaaaaaaaaccccaaaaaaaaaaaaaaaaaaaaaaaaaaaaatttttgcccccttggccccagggctttttaaatttggacattttttttcttgggccccaaatttggccctctttgcccaattcccctttttgggggggtttttatttgggccggtttttacgtgggctggg

SEQ ID NO: 459445 - DNA, 8785 bp, Homo sapiens
  misc_feature (1472)..(1472): n is a, c, g, or t
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459446 - DNA, 8854 bp, Homo sapiens
  misc_feature (1487)..(1487): n is a, c, g, or t
atcgatgccacgactggattcgggttcagctctgcaccaagtccagtcgtggccacgacctcaagatctcggctgaccagcgtgcagggctgtttttctgagaacatcctttccccctaatgaccgaggccagcaaatcatcctcatgggatgctccagaattggtagctcccttaggaaaacaccggtgtttatcgatgccactcccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggcccaattttaaacaaaaacctaggccgggtgtggtggctcacacctgtaatcccaacactttgggaggccaaggcaggcaaatcacctgaggttgggagtttgagaccagcctgaccaacatggagaaaccccatctctactaaaaatagaaaattagccaggtgtggtggtagatacgtgtaatctcagctactcgtgaggctgaggcaggagaattgcttgaatccgggaggcggaggttgcagtgaactgagattgcaccactgcactccagcctgggcgacagagtgagactccgtctcagaaaaataaaaaacaactttggacatagaggagttgggggcagaggggggaggatgagagaattttccatgtaactccttttccttaagaaaaagaagcaaaaatccctcatgcagtgccatctgactttatggtgtttcacattatatagttactttttttaataaacgcataagattaactcttcctgcaacccaaggtggatacttggatgtttgatttttatttatttatttatttattttttgnggcagtctctctctgttgcccaggctggagtgatgcgtgatttctgctcactgcagtctctcccacccgggttcaagcgattctcctgcctcagcctcccaagtagctaggattacaggcgcgcaccaccacgctcagcctgatttctaggctgaaaaggctgggactcaggtactttccccagttgggactgaactttctcatcagagaatgggcctcagaagcaatgttcccaaacttgtggttgggtcatcgtggaaaagaaacctcaaataagaaaaataattacaataagaaatggattttcttttttcccacaacagttatacattataaagaacagactgtcgtagaaaactgtctttgcttccaaatcagcagaggaccattgtatgtattgtcaggtctttatataagagtgaaacctttatttatgcttcttgtgagtagagaataaattttaaaactaattagatgaaattaagaacagagtattggaacatctctgtgttttccggaatgtttactcaggtccatgaatgctgtgatgctgggaacttagggaagattcaccaaaatttgagagtgataaaaatggcctaaaatgggaaatggtgagcactcttattattagtgagattggtcaatcagcccatttgaaatgggtaaaaaatactttcagtaaaataattacatattatatataaaatatttctttttttgagggcagctactgagtgataaaagcatagtagaaatcactttggttaaaagtaactcaaatttttctcttaagtaatctaccaacttcctgatgtttttctttaatattttggaactgttcaagacagaatggagcctacatatatggtgttccactagtatgttgaaaatgtcatatcatggagaatggagacaccttccaggtgtctgttaaacccatcttctctgtgtacttctggcatcttttttggtaggatcatttggcagggggtagagtacctgtacttttggcaccattgaaaccagctctggcccacttgtttgaatagctatcagactcagcgtctctatatgctttatatacagttgagagaaccagtgtttaatgctcttgaaattgtatcttccatgcttcagaccagatgcatttaacaaaatggatatattccagctgtagttgcccagtgtttacttaacacatctacatttttttcttgtctattttggtccccttgataggaaaagctataattttaggcaggactatacgtcgatttgtagccatgcttccttcctttcccttgctcatccatgttagctggcagtttttcttttgaaaagttaaaaccgggatatgtgcaatagaaatatatatatatatatgtatattttaatacttgtggacaaatgttacaagttgtttaagaacaacaaaatcaccaatgtcttccattttgagatgtgtatagttttgtaagcattagtgcttggtagcatattgtagtgccatgttaggggttagtgcatgagtctagtgattttaaacttcaggatgaattattgataataacaaatagtgtaaaaagagtggaaaatctaaaccttttctttttccataatgtctaaatctgttatattcttcctggggaaaagagattaaggcccaaaagactcatttatgaatagaaatgtggggtcaaaatctgagatactatatttgaggacatttcagctttccataaggtatctggaaaccagctgtctttgtgtcttatgaaacctcaagtcaaaatgagaccgcatttaattattctgctttgctctttttttggggtgggggggagatagagtttcactctgtcacccaggctggagtgcagtggcacaatctttgctcactgtaacctctgcctcttgggttcaagtgattctcgtgccccagcctcccgagtagctgggactacaggcacgtgccaccacgcccagctaatttttatatttttagtagagacggggtttgctgtgttggccaggctggtctcaaactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca

SEQ ID NO: 459447 - DNA, 6196 bp, Homo sapiens
tgggaacggcccaccgcagggttggccaccttgagaagctgcgaagatggcggagtaaggcgtgccgctgcaaactggcctctgggccgggggcgagcagcccccgggaggccgagtgcatctgttggaccgtgcgaggagaagaaaaaaaatatcggccagaggagaggaactaaccgaacattcttcctccctaccttatagaggggagtggtcatctacactaaagcaaagtgttaggcgcgtccgtgcgaagagaccaccaaacaggctttgtgttccttatcacaggaagaaaattttccttgacctttaggtgcttttatattcatctcaaaaacaaaattctgaactcaggacttggcaagtgtctctatgttgtctcctagagtgggtagtcctgcttcttttacccagttactttccctgtttttgaaatgtggctatcacttctctacacattacctccatgatttggaatggaaaaggccacttttctttttgttctgcctctcaaattcaacacagaggagctcctaggattccagttatcctgctaacatctccaggaagaaagaagcaactcacatgggtcttttgctgtttgcttaattataaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcactcctgacctcaagtaatccacctggcctgctcttttcatgtcttaacatggcatgtcttttagtttcattattttcctactccttgtatgtcaagaaattacattttgcatgtcttatggagatgctgttaattgcttcagtgagtgcttttctaatctgcagaccatttacatttcctgtttgcagcatgctgtgtgcaaacactcagtaatttggagtattcaattatttgttagggctcttcctatttccaaatgtgctgaattgtctattgatgggattttcagatcttttcatgagaactggaaatgtagctgggtggcacctacctaggttgctacgtagtgagtagactttctcttgggtatagtaagcctcagacagctttcacttttatctactttacttgtggaaataaaacagtcattttgttctgaaagaataagatagctttctgtagagaaggaattcctacctctaaaagctgccttgagaactcagaactggcagttttctgaggtgatttttaaatttcagtattagggagagtccagcatttgctgacacagattctacataactaatgtatgatagcaaatgcaaaactattataatgtggtgtatcttgcgcatacacaggttagaacaagtagactctggcagcagatctccagagacccaagtttaggttctcatagtgtatttgaagtagttatactcctggcttaagtagtttagtgcctgggagaatccattactgaaaagcatttaacttaaaaaaaaaaaaaatgaaaaggtagtgaatacagaatagcacaatatataggaaaggatatttcctgttgaaaaaaaaagccataaaattaatagtaattttcaagaggtagaattttagtagcaataagtttgtgcatgtatagtaatttgcattagcaaggttgtacaatagaataagtgatactactggagtttgtggggctctgcaaccaagagttgcacaagggccaggtgcggtggcttacacctataatcccagcactttgggaggccaaggtgggcggatcacaaggtcaagagatcaggaccatcctggccaacatggtgaaatgccatctctactaaaaatacaaaacttagctgggcatggtggcacatgcctgtaatcccagctactcaggaggctgaggcagtagaatcacttaaacctgagaggcggaggttgcagtgagctgagatcacaccactgtactccagcctggtgacagtaagactccacctcaaacaaacaaaaaatgcacaaaaggaaaaaatgttctggataaagagcatatgaaaggtactttcttttagaacagtatgaatgtatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggcatttattttgtagaatggtatactttctgctttgtctcctcatctttctccactggtttcctgggtacattttttttaaagggagagaagtttgtgagtttaatgttttaaaaaaactcccaagaacatggataagccggatttctctcatgcttatgattagggagttaggatttaaagatgcaaagcagaaggactgaaaggaatagccagtgaatatgtttcagtgggtgaggtgtgaaaccttgtctaatatagatgtgtcctatggcctgtgactgcttattctttatcaatgagaactcagcaaactagtttctttcttgatctgaggaaccacacagctcacatcagaatataatagtggaactagggtgacttcactccctttcacctgatgtctatcttggccttttagcaccttgactatccctgaaaagactgggtctttgttttcccagggaaaaaacgaagtgatgtagatctaagaaatagtgcctctttaatatttaattcttacatgacaactaacacacagggaaaaggctatgttaagttgattatagctcctcttaaaatgtcctatgctgtcagttggtcttagagacatgggaataaccaagcaatattcagacatctgcactatctggggacagcgctacatagtacaatgatgtcagcagttcagttacttggaacaattaaagattacccttaacagccatgttaatacatctaaatgctaaaatatactacgagtttttcatagtcttgaaagtatacagttaattacttttcaaagttactgtggtctcatgtttactcttcttgtatctgtgatatgcaaaaagatgaagactcttggcctccaggagtttacattctcatggtgctgttggttcaagcagattgctttagtttattaatgaacattgcttggctattaattatatcctatttggaaggatcccttggtgaacagttttaaaaagcagagggctgtgctaaatttcagggtattgatagcttgagtttacattgtattagccctgctcgttatcatttttttccccagggagctatgcaggtaatgctcattagcatgaatcagaaaagaaaccattctgcctaagagcatcttaaccatccccctaaaccacctatgctctcctgttatagttgtcagtaaatcacgaagaaaattaacagctccttaagactctacatccctcaattctctttcttttcccagagtttgtacatcattctctactcagatggaccaggatttgcatataagccttttaaaactgactagtggtcctaattttaacatttttgtgtatgactcctatcccttttctgaagcagcattgtgatagatgtggagcttctacctgcatttctaagcaattattaacccaacttttgagttgaaacttgcatggatccttgttatgtcccgtaattcctctgaatcaaggaatttattttgcatgcttattaaactcaaactgggtctgattgaaagtgcaagcaatagtgacaggaccttaactctggttttagagtacgaacattctaatgcatgactcaaaatgtccagtgttgtggttactagttattttatatatgcatttgttaataatgaagcaatagagactaagaccaatagcttgaatatattcagattattttcatgttttaataaaggatttttcttacttccattgaaaatgggaagtagaagataaacaggggcaaccacaagacattcaaactgtcaggactagggcgtagcagtgcccaccctctaaccacttgcctggttccattagtccccaagcatgtttgaaaacaaaagacacaaactaagcatgctgaataaaactagctgctatggctgtaataatcagaaaggtgcagagtttcagaaagagtaggaaagtagggaatgccagtatggagtatgtaaaataactagatatggatatggggtttgtttatgatatgctttatgtagacaaagtttgaggtcttttaaaactgggatttgagttgaaaagagtcaggatgcacatatttccactatttcaggattttcagatgactaggcacatgttgtggatgatactggtaccaactaccaatgaccaactataaagtacccctgcaataagggagacttcctttttgtagaatagtcctgaaaatactgacagatctgtggttagtttgttattttattgcataaaaaacagtttaaacaaattttatagccaaagttttatccttgatgggtttggccagactgcaatttcttgactaaagcttttaatgccaggttaaacaggagaaactttttccactagaagaaaatccttgctatctattttttccaatagaagaaaatccttgctatttattttatttgatgaataaacaaatttattgcagtagcttaaaaaaattttttttttaaacagtctcactctgtcgcccaggctggagtgaagcaatgtgatctcagctcactgcaacctccacctcccgagtagctgggattacagacatgcaccaccaccctcagctaatttttgtatttttagtagagacggggtttcgccatgttggccaggctggtctttaactcctggccttacgtgatccgcccccccttagccttccaaagtgctgggattacaggtgtgagccactgcacctggcctgtagtagcttaaaattttccttgagaaaattcctgactttaaaaataacccttatataagtacaagtgattgtgacaaatgacgtaaaaatggcattcatgatgtctgaaacaagcctaaatagaattcaagattagactaaatgattttcacaaagcacattcaaggttttacattctatgattgaaaaaaattttttgaaaactttttatttcattctttcctgtaggattttgctacaaataactttgggaatgaataaagtggaatggtaactttccagtggttcagaattgaattagacttcttgtgactgtgatgtttggtttccattgaaatatatgaagtgagatgtcatatcctgaatatagtttgtcttccccaattacttgatagcatgtctgtcagccagtaaagattaagaacagagtttctctaaattcctccgattattccactaaggcacattaaaatacttaattttgggaaaccagacatcacagatttctccatgaagtcctaaatcttctttaaagtcagaataggtatcttagttactgacagtattcaggtttttttctcccttggtgatatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatctatgcatctttggggtttttgaagaaatttaattctttgatgtaaaaaggaactgttaaaaaagttggaagctctgcacctgtgtatatatatattttagcaataaagcagcatgggctgagaatgca
